US010378007B2

(12) United States Patent
Juillerat et al.

(10) Patent No.: US 10,378,007 B2
(45) Date of Patent: Aug. 13, 2019

(54) METHODS FOR MODULATING TAL SPECIFICITY

(71) Applicant: CELLECTIS, S.A., Paris (FR)

(72) Inventors: Alexandre Juillerat, Paris (FR); Philippe Duchateau, Draveil (FR)

(73) Assignee: CELLECTIS, Paris (FR)

( * ) Notice: Subject to any disclaimer, the term of this patent is extended or adjusted under 35 U.S.C. 154(b) by 613 days.

(21) Appl. No.: 14/424,757

(22) PCT Filed: Aug. 30, 2013

(86) PCT No.: PCT/IB2013/002830
§ 371 (c)(1),
(2) Date: Feb. 27, 2015

(87) PCT Pub. No.: WO2014/033556
PCT Pub. Date: Mar. 6, 2014

(65) Prior Publication Data
US 2015/0218230 A1    Aug. 6, 2015

Related U.S. Application Data

(60) Provisional application No. 61/696,254, filed on Sep. 3, 2012.

(51) Int. Cl.
| *C12N 15/10* | (2006.01) |
| *C07K 14/195* | (2006.01) |
| *C07H 21/00* | (2006.01) |
| *C12N 15/82* | (2006.01) |
| *C12N 15/63* | (2006.01) |

(52) U.S. Cl.
CPC ............. *C12N 15/10* (2013.01); *C07H 21/00* (2013.01); *C07K 14/195* (2013.01); *C12N 15/102* (2013.01); *C12N 15/63* (2013.01); *C12N 15/8216* (2013.01); *C07K 2319/80* (2013.01); *C12N 2501/60* (2013.01)

(58) Field of Classification Search
CPC .. C12N 15/10; C12N 15/8216; C12N 15/102; C12N 15/63; C12N 2501/60; C07K 14/195; C07K 2319/80; C07H 21/00
USPC ................... 536/23.1; 530/300, 350
See application file for complete search history.

(56) References Cited

U.S. PATENT DOCUMENTS

| 2011/0145940 | A1* | 6/2011 | Voytas | .......... C12N 9/22 800/13 |
| 2013/0137173 | A1* | 5/2013 | Zhang | .......... C12N 15/63 435/375 |

OTHER PUBLICATIONS

Cermak et al. (2011) Nucleic Acids Research, vol. 39(12), e82, pp. 1-11.*
Romer et al. (2010) New Phytologist, vol. 187, 1048-1057.*
Arnould, S.P., et al., "Engineering of Large Numbers of Highly Specific Homing Endonucleases That Induce Recombination on Novel DNA Targets", J. Mol. Biol. (2006), vol. 355:3, pp. 443-458.
Boch, J. et al., "Breaking the Code of DNA Binding Specificity of TAL-Type III Effectors", Science (2009), vol. 326:5959, pp. 1509-1512.
Cermak, T. et al., "Efficient Design and Assembly of Custom TALEN and other TAL effector-based constructs for DNA targeting", NAR (2011), vol. 39:12, pp. e82 (12 pgs.).
Chames, P. et al., "In Vivo Selection of Engineered Homing Endonuclease Using Double-Strand Break Induced Homologous Recombination", NAR (2005), vol. 33:20, pp. e178 (10 pgs.).
Epinat, J. et al., "A Novel Engineered Meganuclease Induces Homologous Recombination in Yeast and Mammalian Cells", NAR (2003), vol. 31:11, pp. 2952-2962.
Moscou, M.J. et al. "A Simple Cipher Governs DNA Recognition by TAL Effectors", Science (2009), vol. 326: 5959, pp. 1501.
Schornack, S. et al., "Characterization of AvrHah1, a Novel AvrBs3-Like Effector From Xanthomonas Gardneri With Virulence and Avirulence Activity", New Phytologist (2008), vol. 179:2, pp. 546-556.
Smith, J.S. et al., "A Combinatorial Approach to Create Artificial Homing Endonucleases Cleaving Chosen Sequences", NAR (2006), vol. 34:22, pp. e149 (12 pgs.).
Cermak et al., Corrigendum—Efficient design and assembly of custom TALEN and other TAL effector-based constructs for DNA targeting, Nucleic Acids Research, 2011, vol. 39, No. 17, 7879.

* cited by examiner

*Primary Examiner* — Anne Marie S Wehbe
(74) *Attorney, Agent, or Firm* — Arrigo, Lee, Guttman & Mouta-Bellum LLP

(57) ABSTRACT

Methods for improving or modulating targeting specificity of TALE proteins by introducing alternative RVDs into their modular nucleic acid binding domains. Polynucleotides encoding TALE proteins having alternative targeting specificity towards a nucleic acid target sequence. TALE proteins having alternative targeting specificity towards a nucleic acid target sequence and methods of making and using them.

8 Claims, 15 Drawing Sheets

Figure 1A:
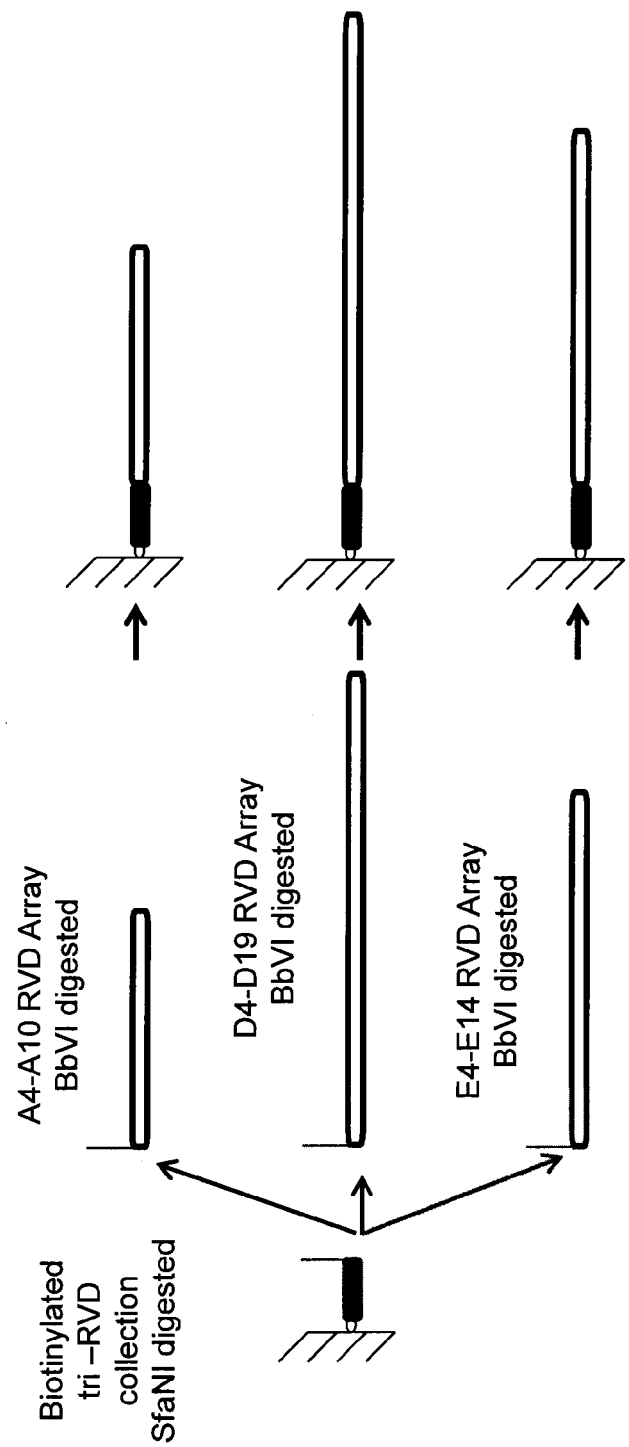

Specification includes a Sequence Listing.

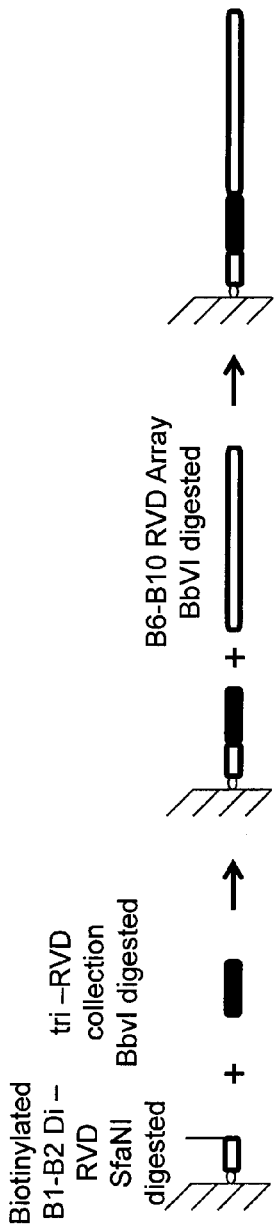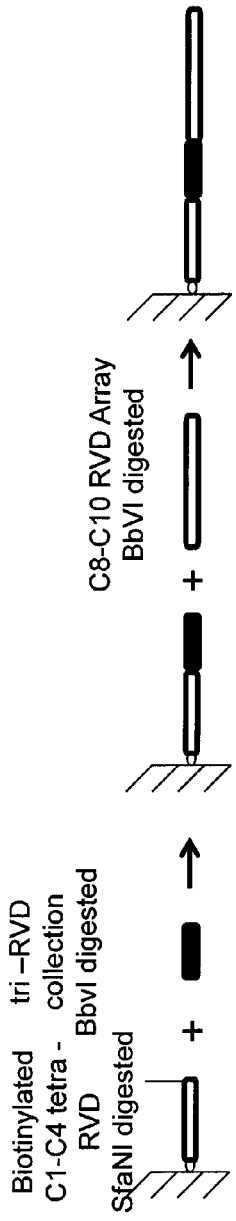

_US 10,378,007 B2_

1

METHODS FOR MODULATING TAL SPECIFICITY

FIELD OF THE INVENTION

The present invention relates to methods for improving or modulating targeting specificity of TALE proteins by introducing alternative RVDs into their modular nucleic acid binding domains. The invention can be used in silico to design or identify TALE-nucleases by predicting their targeting specificity towards their putative cognate nucleic acid target sequences and vice-versa. This application claims priority to U.S. Provisional Application No. 61/696,254 filed Sep. 3, 2013, the entire contents of which are hereby incorporated by reference.

BACKGROUND OF THE INVENTION

Transcription activator-like effectors (TALEs) are proteins originating from bacterial plant pathogens of the _Xanthomonas_ genus with the ability to target specifically DNA sequences in a base-dependent manner. The binding domains of these proteins are composed by an array of highly similar 33 to 35 amino acids tandem repeats, which differ essentially by their residues 12 and 13 (variable di-residues or RVDs). In the wild, TALE proteins are able to selectively target DNA promoter sequences during the process of infection of the plants by _Xanthomonas_. The study of these RVDs in relation with the natural promoter DNA sequences recognized by the protein AvrBs3, a representative protein of this family, has revealed a specific correlation between the RVDs found within the TAL effector DNA binding domain and the nucleic acid bases present in the nucleic acid sequences. As a result, a code has been established between amino acids and nucleic acid bases, so that it is now possible, by following said code, to engineer TAL effector DNA binding domains by assembly of selected RVDs to target specific DNA sequences (Moscou and Bogdanove, 2009, Boch et al., 2009, Scholze et al. 2009). The remarkably high specificity of TALE repeats and the apparent absence of context dependence effects among repeat in an array, allow modular assembly of TALE DNA binding domains able to recognize almost any nucleic acid sequence of interest.

The recent achievement of the high resolution structure of TAL effectors bound to DNA confirmed that each single base of the same strand in the DNA target is contacted by a single repeat motif and that the specificity results from the two polymorphic amino acids in positions 12 and 13. In addition to the central core mediating sequence-specific DNA interaction, TALE proteins are composed of a N-terminal translocation domain responsible for the requirement of a first thymine base (T0) of the targeted sequence and a C-terminal domain that containing a nuclear localization signals (NLS) and a transcriptional activation domain (AD). It has to be noted that the last repeated motif is only composed of the first conserved 20 amino acids (terminal half repeat).

Despite the fact that natural TAL effector are composed of repeated motifs arrays greatly varying in term of number (ranging from 5.5 to 33.5), it has been shown that at least 10.5 repeats are required for maximal transcriptional activation activity and that the number of repeated motif do not directly correlate with a stronger activity.

The remarkably simple one-to-one repeat/base association found in TALE proteins has been used to create and engineer arrays that were subsequently fused to various catalytic heads, such as transcription factors and non-specific nuclease domains (TALE-Nuclease). TALE-Nucleases are using the non-specific nuclease domain of the restriction enzyme FokI. Since FokI is activated upon dimerization, TALE-nucleases have to function by pairs, the double strand break (DSB) occurring within the spacer sequence separating the two opposing targets. Taking advantage of the two conserved pathways, non-homologous end joining (NHEJ) and homologous recombination (HR), that are used by nearly all organism to repair DSBs, one can introduce, at a desired specific location in the genome, small insertion or deletion (indels) within a gene leading to gene disruption (through NHEJ) or completely introduce/replace a gene of interest (through HR). The modularity of use of TALE-nucleases has been confirmed to a certain extent by the assembly of designed molecules and the resulting detection of alteration at endogenous genes in various organisms such as yeast, plants, nematodes and mammalian cells.

Nevertheless, up to now, researchers have mainly published successful use of TALE-nucleases without reporting how frequently a TALE-nuclease fails to work. The designs of these arrays still relies on the published code (Moscou and Bogdanove 2009, Boch et al. 2009) represented in FIG. 1, which in fact provides different RVDs for different nucleic acid bases and vice-versa. In practice, it is observed that in a number of cases, engineered TALE proteins do not work or don't have the expected level of specificity or activity towards their nucleic acid target sequence. Under these conditions, it remains difficult to predict the level of specificity of an engineered TALE binding domain until it is assayed. For TALE-nucleases, cleavage assays are generally performed according to the so-called SSA protocol in yeast cells as described in WO 2004/067736, which requires transformation of yeast with both plasmid encoding the engineered TALE-nuclease and the nucleic acid target sequence to be cleaved in order to measure cleavage activity. It is notably time and money consuming to perform such assays.

On another hand, due to their sequence similarity, it is also time consuming and expensive to assemble tandem repeats when constructing expression plasmids encoding TALE binding domains.

Thus, there remains a need for methods improving the design of TALE domains that would ideally involve smaller set of repeat domains and have a predicted specificity.

This is particularly important to predict the targeting specificity of TALE proteins when creating TALE-nucleases or transcription activators, because these later are used to modify cell lines, which may be used in cell therapy, bioproduction, plant or animal transgenesis. In such applications, it is crucial to control or model off-targeting to reduce potential cell cytotoxicity or side effects.

In order to define rules allowing optimizing activity and/or specificity and/or flexibility of target/TALE-nuclease pairs, the inventors have performed an extensive study of activity, specificity and context dependence of four different RVDs (NN, NG, NI and HD) on the first 7 RVDs/base positions in a context of a TALE-nuclease of various length. This study, which is detailed in the experimental part of the present disclosure, systematically tested all possible combinations of the four RVDs with respect to the four bases A, T, C and G within triplets.

Accordingly a collection containing the 64 possible combination of three RVDs, either on position 1/2/3 or 3/4/5 or 5/6/7, was screen for activity on a collection of 64 targets containing all combination of A, T, C and G bases, either on position 1/2/3 or 3/4/5 or 5/6/7. Hitmaps of the mutant versus the targets allows visualization of the frequency and intensity of cutting of mutants on their respective targets (diagonal) but also of the frequency and intensity of off-site activity of the mutant. In addition the same study was performed on the first 3 RVDs/base positions (1/2/3) in a context of a TALE-nuclease of 18.5 repeats in total.

To the knowledge of the inventors, this study is the first involving a systematic approach involving synthetic DNA targets containing all combination of A, T, C and G bases. The previous studies that led to establish the basic RVD code were based on statistical analysis of RVDs naturally occurring in the wild with respect to natural DNA targets (i.e. based on natural diversity).

The data from these experiments are bringing information on context dependency for a RVD/base pair, relative to their position in an array but also on the context dependency for off-target of a particular RVD for all targets, relative to its position in the array.

The collected data has permitted to establish methods and procedures to design repeat sequences with improved or modulated specificity (e.g. avoid RVDs which recognize AA and CA in position 1 and 2 to optimize activity), which are the subject-matter of the present invention.

Contrarily to the teaching of the prior art, it results from the data obtained by the inventors that the RVD NI can be used to target T or G and HD or NG to target G. Accordingly many "non-standard" RVD triplets (by reference to the standard code established by Bogdanove) could be introduced in the repeat sequences resulting in an equivalent or improved specificity with respect to a given target sequence. These alternative RVD sequences allow the design of active TALE-nucleases starting with only subsets of the 64 tri-RVDs or 16-diRVDs (NN, NG, NI, and HD combinations). They are also interesting, for instance, to design strategies to target DNA sequences homologous to a given target DNA sequence, without this later being itself targetable.

Data from these experiments also bring information on context dependency for a RVD/base pair, relative to their position in an array but also on the context dependency for off-target of a particular RVD for all targets, relative to its position in the array.

In a general aspect, the present invention relates to method allowing the design of repeat arrays with modular activities. The invention allows increasing or reducing the activity on certain targets (activity), increasing the specificity of a repeat array to one target compared to all other possible targets, reducing off-target events (specificity) and decreasing the specificity to have one array of repeat targeting more than one targets or only a certain set of desired targets (flexibility).

SUMMARY OF THE INVENTION

Figure 3:
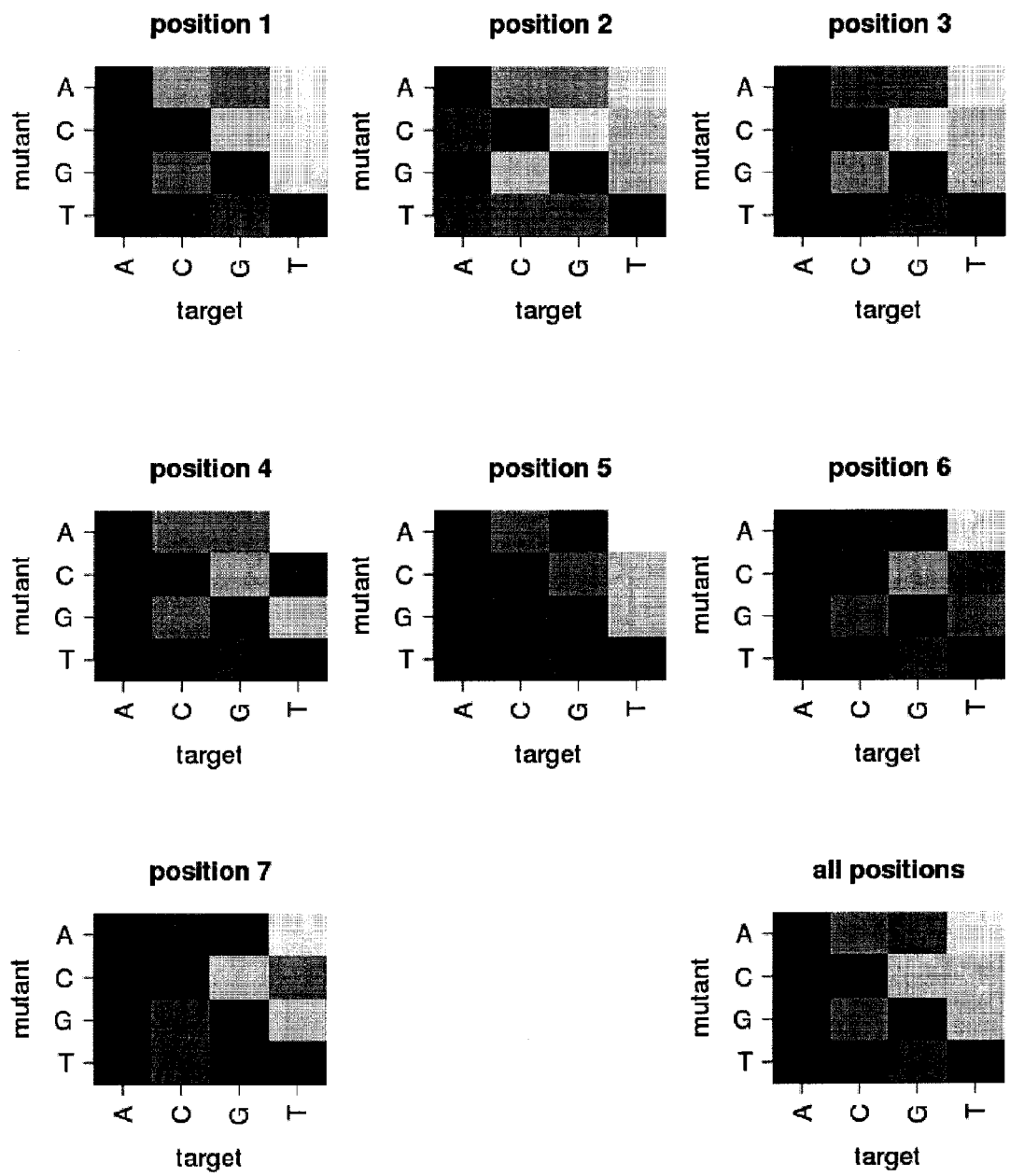

The inventions disclosed in the present application result from the experimental work achieved by the inventors, which consisted to test all possible interactions between the main RVDs NN, NG, NI, and HD and nucleic acid bases A, T, C, and G in TALE-nucleases. This work has more particularly permitted to establish a new matrix for the TALE code, which is illustrated in FIG. 3. In comparison with the initial code established by Moscou and Bogdanove, and similarly by Boch et al. (2009), from the study of naturally occurring TALE proteins, it is interesting to observe that RVDs may have affinity with any of the A, T, C and G bases, whereas in Nature they were identified as being specific to only some of those. For instance, unexpectedly, NI can be used to target T or G and HD and NG to target G, whereas such interactions are not found in natural TALE proteins.

Thus, one aspect of the present invention is a method for synthesizing a polynucleotide sequence encoding a transcription activator-like effector (TALE) protein, said protein having alternative targeting specificity towards a nucleic acid target sequence containing nucleic acid bases T and/or G, wherein said method comprises assembling at least 10 polynucleotide sequences encoding repeats which comprise each one RVD, each RVD having specificity to a nucleic acid base in said nucleic acid target, and wherein at least one of said 10 RVDs are selected among the alternative RVD code:

-NI to target T;
-NI, HD or NG to target G.

It also results from the experimental work made by the inventors that the RVD code is more flexible than observed in the prior art, in the sense that any of the main RVDs (NN, NG, NI, and HD) can be introduced in TALE sequences to target any nucleic acid base (A, T, C, G) with the possible effect of increasing, modulating or reducing targeting specificity. Tri repeat domains comprising alternative triplet RVDs according to the invention are proposed, in particular in Table 3 of the present specification.

Thus, another aspect of the invention relates to methods for designing, identifying, or ranking repeat sequences with respect to one target sequence by calculating their targeting specificity, in particular by using a matrix providing for each RVD, preferably NN, NG, NI, and HD a targeting specificity score with respect to each base position, preferably A, T, C and G present along the nucleic acid target sequence. Such targeting specificity score is preferably established from experimental data by testing all possible combinations of the RVDs with the nucleic acid bases as disclosed in the experimental part of the present application. These methods can be implemented with a computer program, for instance to optimize repeat sequences with respect to a given nucleic acid target sequence.

Conversely, alternative nucleic acid target sequences may be designed corresponding to one repeat sequence thereby allowing identifying more target sequences in a genome susceptible to be recognized by a given TALE protein. This is helpful, for instance, to identify, evaluate or compute off-target sequences into a genome.

The experimental work realized by the inventors has also highlighted the fact that HD or NI was not necessarily the best RVD to target A and/or C within the first positions of RVD sequences (TAL domains), in particular as part of the first triplets 1/2/3.

Also, one aspect of the present invention relates to methods for designing and/or modeling a transcription activator-like effector (TALE)-based protein having, for instance, an improved specificity towards a target nucleic acid sequence, said method comprising introducing at least one RVD HD or NI in the repeat sequence of said TALE protein to target A and/or C in position 1, 2 or 3 of a given nucleic acid target sequence. New RVD triplets for substitution are proposed, in particular in Table 5 of the present specification.

Tables
Table 1:
List of all tri-RVD members of any collection showing activity on specific pseudo-palindromic sequences targets (two identical recognition sequences are placed facing each other on both DNA strands) in our yeast SSA assay previously described (International PCT Applications WO 2004/067736 and in Epinat, Arnould et al. 2003; Chames, Epinat et al. 2005; Arnould, Chames et al. 2006; Smith, Grizot et al. 2006) at 30° C. + represent a low activity, ++ a medium activity and +++ a high activity.

Table 2:

List of all tri-base containing pseudo-palindromic sequences targets (two identical recognition sequences are placed facing each other on both DNA strands) being targetable by a specific tri-RVD member of any collection in our yeast SSA assay previously described (International PCT Applications WO 2004/067736 and in (Epinat, Arnould et al. 2003; Chames, Epinat et al. 2005; Arnould, Chames et al. 2006; Smith, Grizot et al. 2006) at 30° C. + represent a low activity, ++ a medium activity and +++ a high activity.

Table 3:

List of the RVD triplets in which at least 1 RVD does not respond to the standard code, which were found to have targeting specificity whatever be the RVD position in the TAL sequence. These RVD triplets are proposed as alternative triplets according to the invention.

Table 4:

List of all tri-RVD members of collection A (positions 1/2/3) showing activity on a specific pseudo-palindromic sequences targets (two identical recognition sequences are placed facing each other on both DNA strands) in our yeast SSA assay previously described (International PCT Applications WO 2004/067736 and in (Epinat, Arnould et al. 2003; Chames, Epinat et al. 2005; Arnould, Chames et al. 2006; Smith, Grizot et al. 2006) at 30° C. + represent a low activity, ++ a medium activity and +++ a high activity. It appears from this table that targeting specificity is low when using NI to target A bases in the first RVDs of the TAL sequence. Targeting specificity is improved when using alternative RVDs according to the invention.

Table 5:

List of all tri-RVD members of collection A (positions 1/2/3) from Table 4, that can be used as alternative RVDs in position 1/2/3 to target the base triplets indicated in the right columns.

Table 6:

List of possible off-site targets considering a given TAL and using the matrix presented in FIG. 3.A. In the mutant columns it should be understood that A represent a NI RVD, C a HD, G a NN and T a NG.

Table 7:

List of possible TAL considering a given target and using the matrix presented in FIG. 3.A. In the mutant columns it should be understood that A represent a NI RVD, C a HD, G a NN and T a NG.

Table 8:

Experimental and predicted rankings of GFPT3.4 mutant collection on the GFPT3.1 target. In the mutant columns it should be understood that A represent a NI RVD, C a HD, G a NN and T a NG. Te predicted score is calculated using the matrix presented in Table 3.A.

FIGURES

FIGS. 1A, B and C: Schematic representation of the techniques used for assembling RVDs and collection of tri-RVDs as explained in Example 1.

Figure 2:
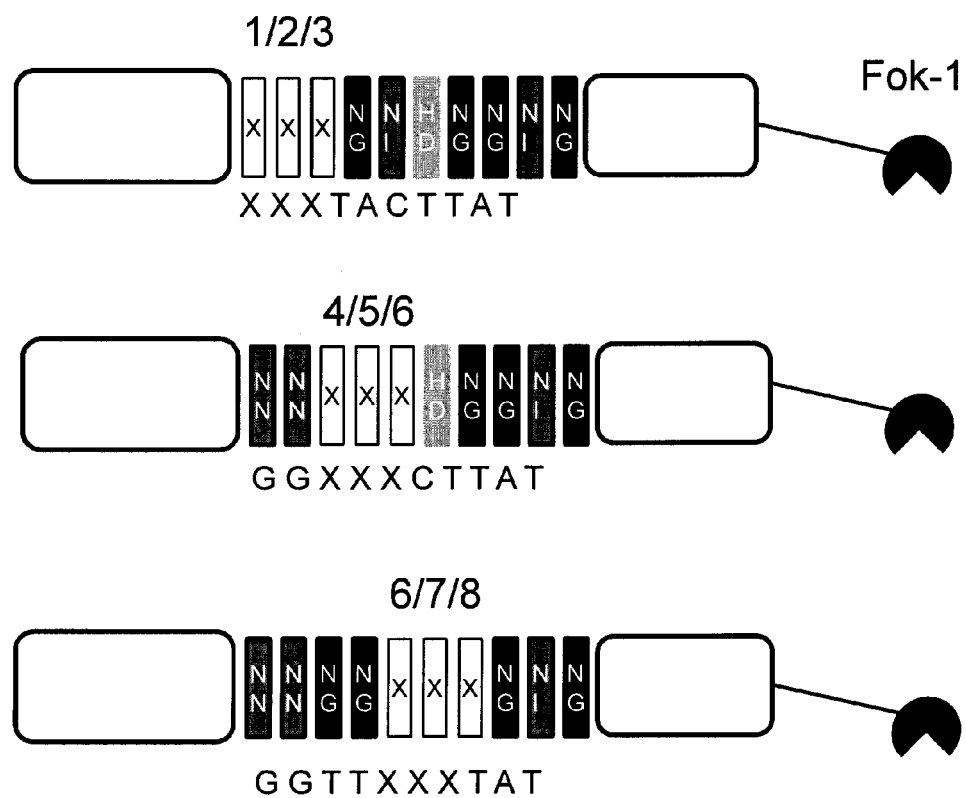

FIG. 2: Schematic representation of the large scale experiments made by the inventors consisting of (1) introducing all combinations of the four RVDs (HD, NG, NI and NN) into 3 adjacent positions (triplets) into the TALE binding domain of a TALE-nuclease targeting RAG gene sequence, or either, (2) introducing all combinations of the four nucleotide bases A, T, C, G into said targeted RAG sequence.

FIG. 3: A: Matrix according to the invention of relative activity of any of the four RVDs (HD, NG, NI and NN) on any bases (A, T, C and G) resulting from the experiments performed by the inventors with synthetic TALE-nucleases. B: Matrix of predicted targeted bases (A, T, C and G) by any of the four RVDs (HD, NG, NI and NN) as established by Moscou & Bogdanove et al., and similarly by Boch, Scholze et al. (2009) from the analysis of natural TAL proteins and their respective plant target sequences.

Figure 4:

FIG. 4: Logo representation of the global specificity matrix and logo representation of the Moscou and Bogdanove code.

Figure 5:
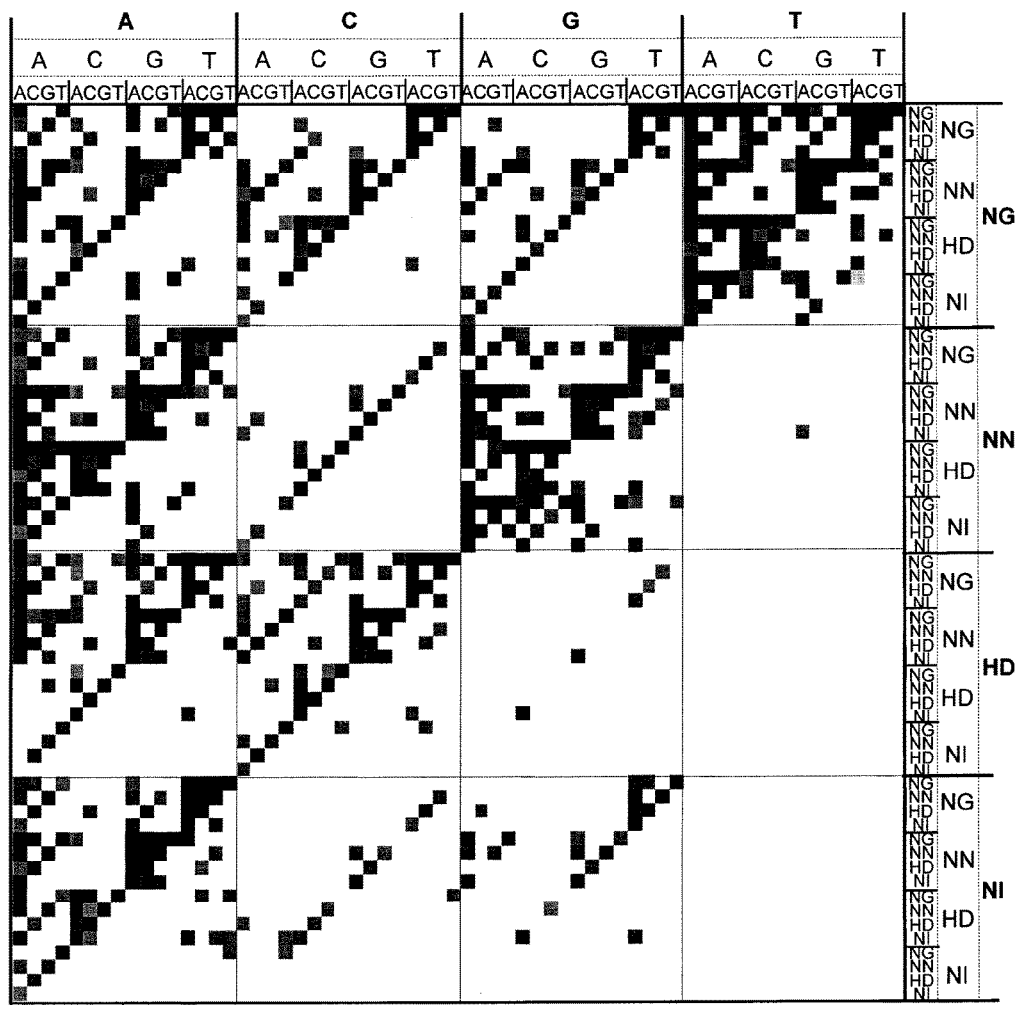

FIG. 5: Activity Hitmap of all Mutants (Y axis) on all Targets (X axis) for collection A. The level of grey indicates the strength of the activity in our yeast SSA assay previously described (International PCT Applications WO 2004/067736 and in (Epinat, Arnould et al. 2003; Chames, Epinat et al. 2005; Arnould, Chames et al. 2006; Smith, Grizot et al. 2006) at 30° C.

Figure 6:
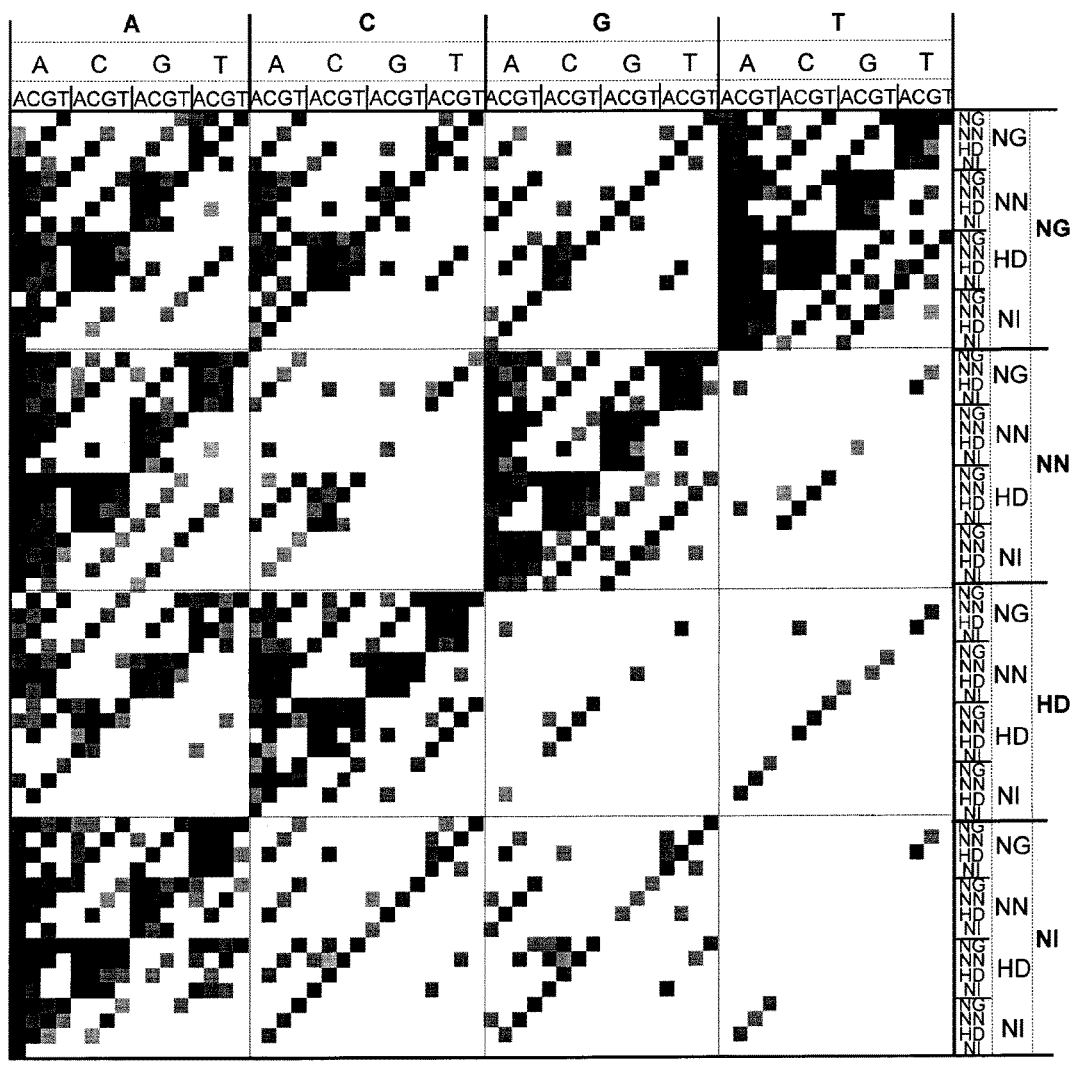

FIG. 6: Activity Hitmap of all Mutants (Y axis) on all Targets (X axis) for collection B. The level of grey indicates the strength of the activity in our yeast SSA assay previously described (International PCT Applications WO 2004/067736 and in (Epinat, Arnould et al. 2003; Chames, Epinat et al. 2005; Arnould, Chames et al. 2006; Smith, Grizot et al. 2006) at 30° C.

Figure 7:
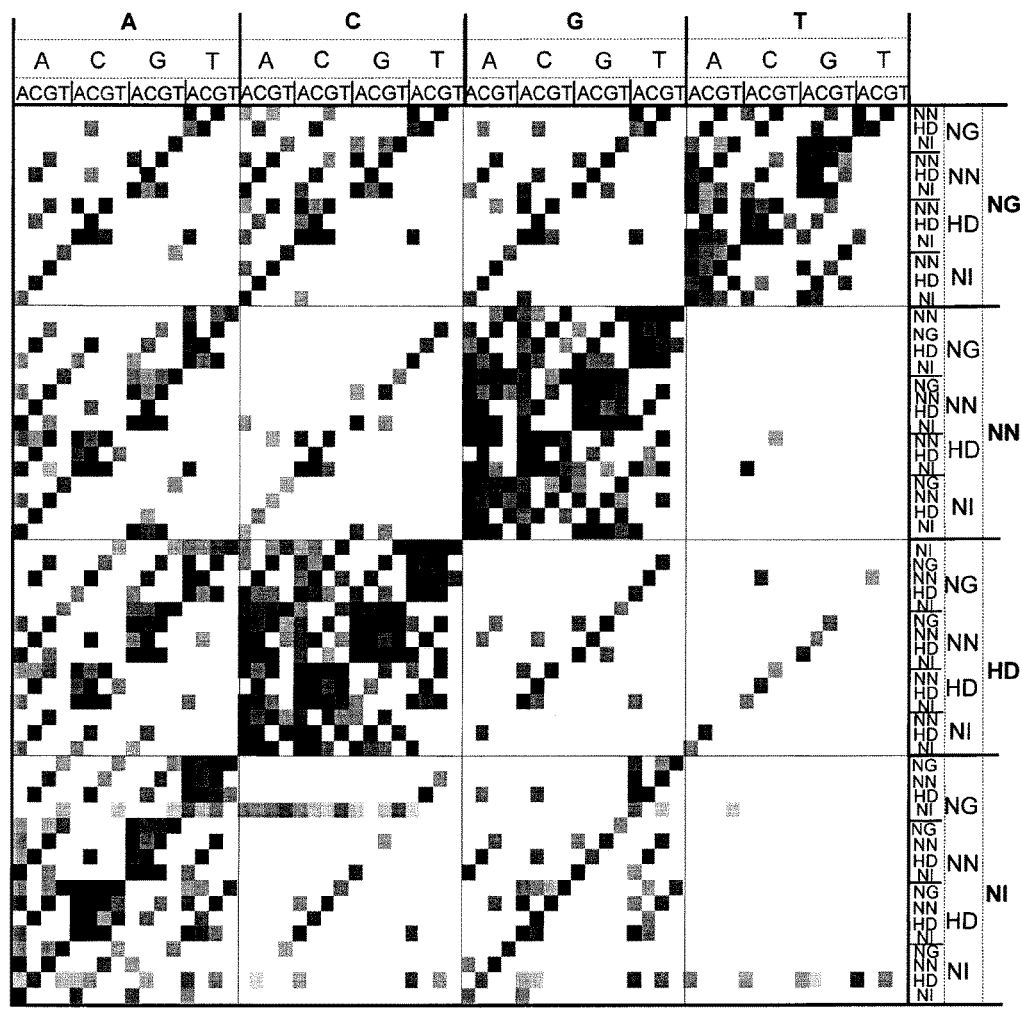

FIG. 7: Activity Hitmap of all Mutants (Y axis) on all Targets (X axis) for collection C. The level of grey indicates the strength of the activity in our yeast SSA assay previously described (International PCT Applications WO 2004/067736 and in (Epinat, Arnould et al. 2003; Chames, Epinat et al. 2005; Arnould, Chames et al. 2006; Smith, Grizot et al. 2006) at 30° C.

Figure 8:
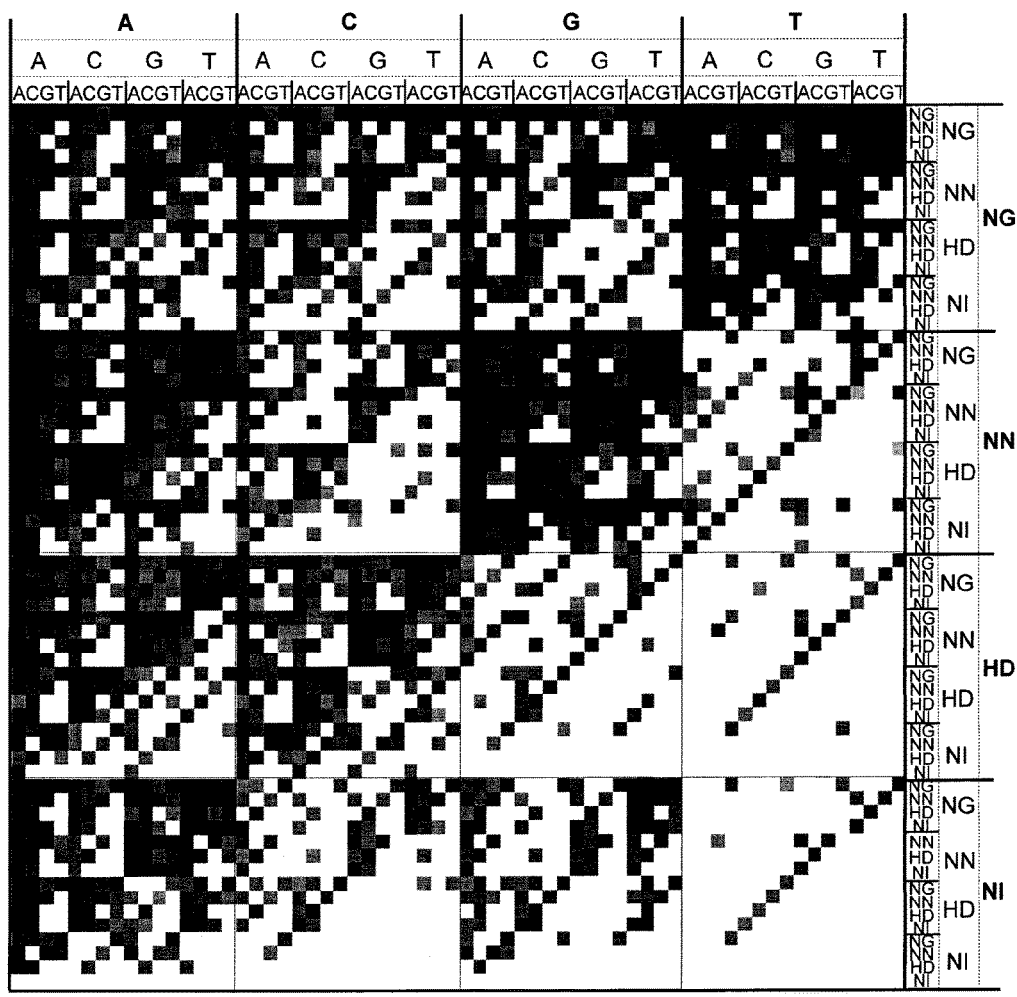

FIG. 8: Activity Hitmap of all Mutants (Y axis) on all Targets (X axis) for collection D. The level of grey indicates the strength of the activity in our yeast SSA assay previously described (International PCT Applications WO 2004/067736 and in (Epinat, Arnould et al. 2003; Chames, Epinat et al. 2005; Arnould, Chames et al. 2006; Smith, Grizot et al. 2006) at 30° C.

Figure 9:
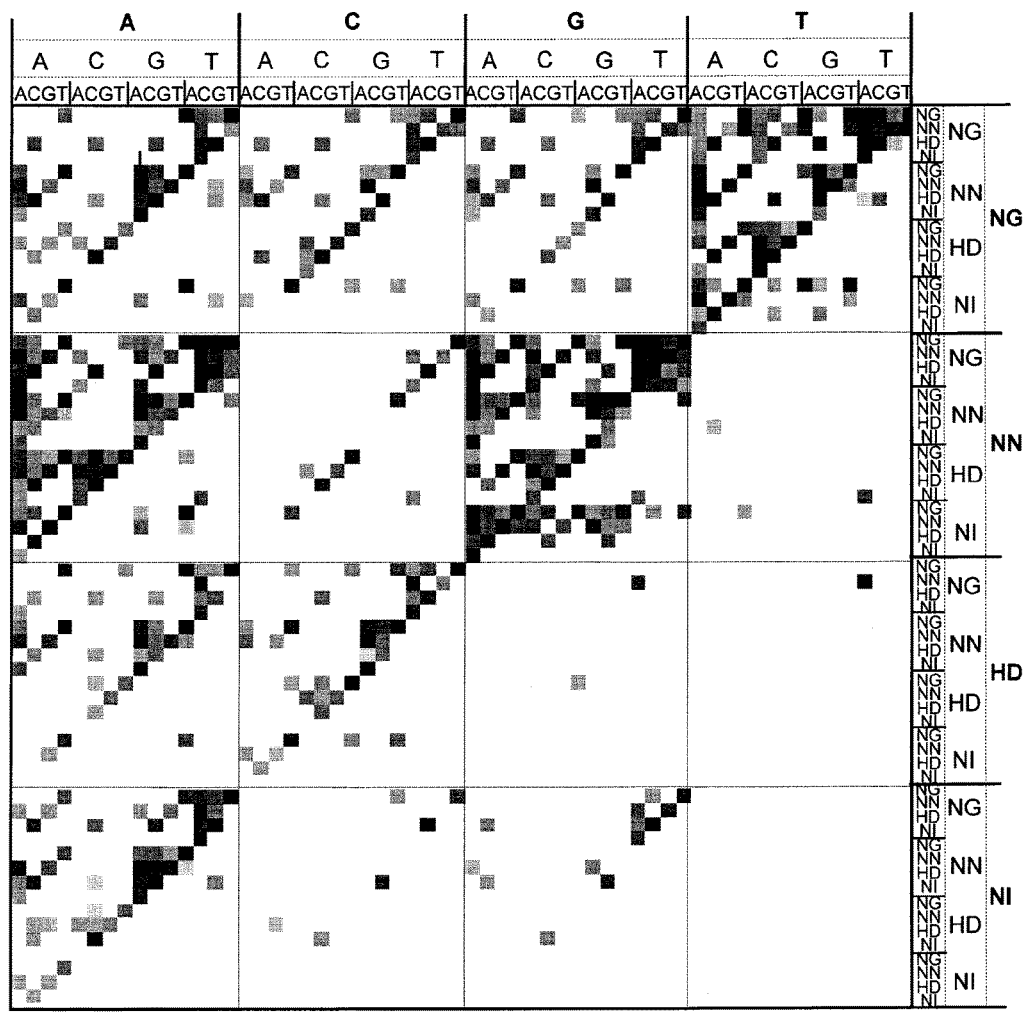

FIG. 9: Activity Hitmap of all Mutants (Y axis) on all Targets (X axis) for collection E. The level of grey indicates the strength of the activity in our yeast SSA assay previously described (International PCT Applications WO 2004/067736 and in (Epinat, Arnould et al. 2003; Chames, Epinat et al. 2005; Arnould, Chames et al. 2006; Smith, Grizot et al. 2006) at 30° C.

Figure 10:
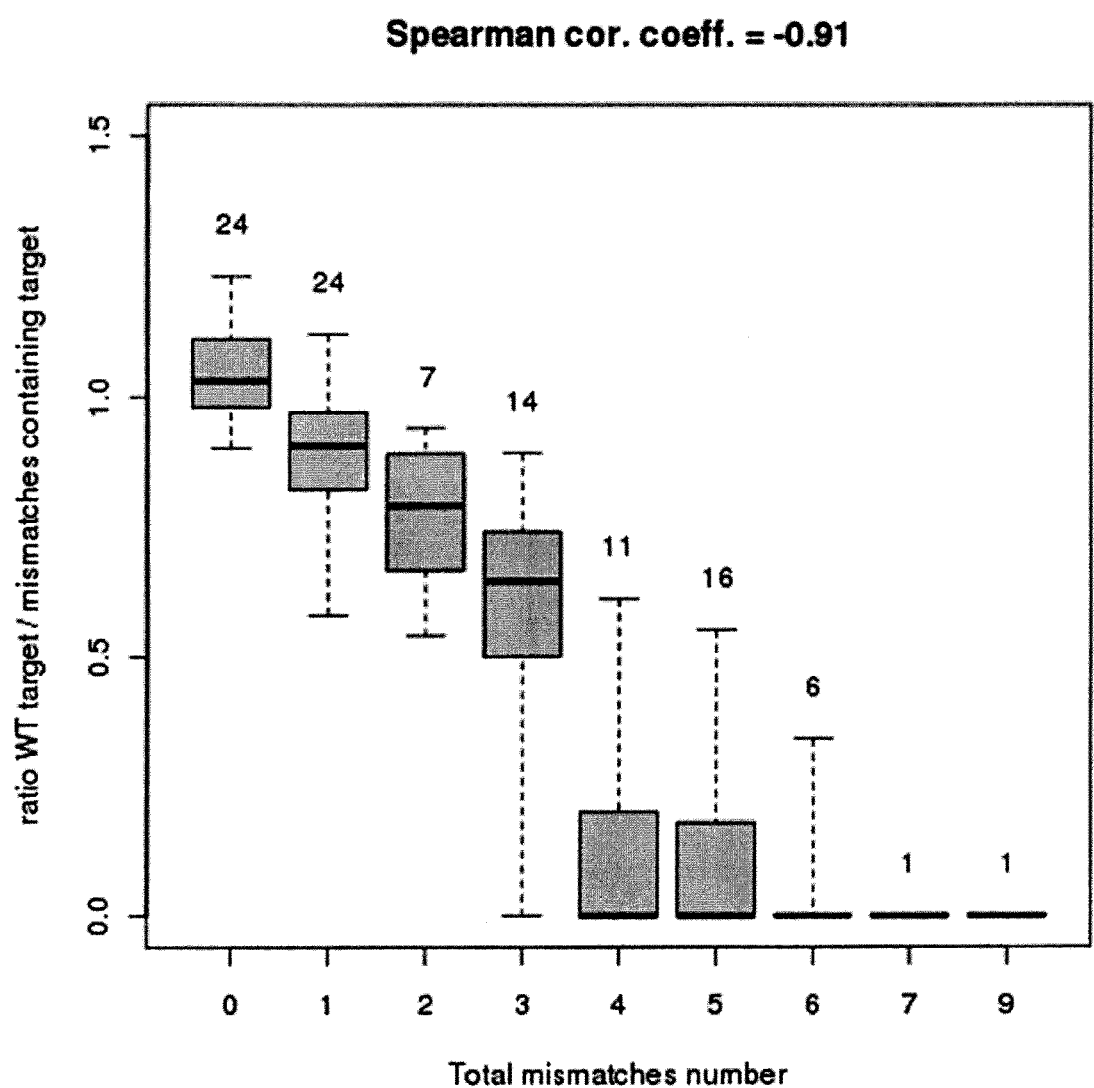

FIG. 10: Relative activity (mismatch containing targets versus wt target) in function of the number of mismatches number (total of both DNA binding sites). The activity on targets not containing any mismatches in both DNA binding sites is shown as a positive control. The distribution shows a strong and significant (p-value: 2.2e-16) Spearman's correlation coefficient.

Figure 11A:
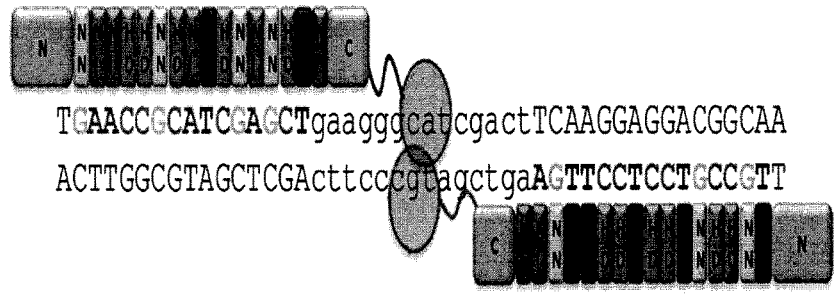
Figure 11B:
Figure 11C:
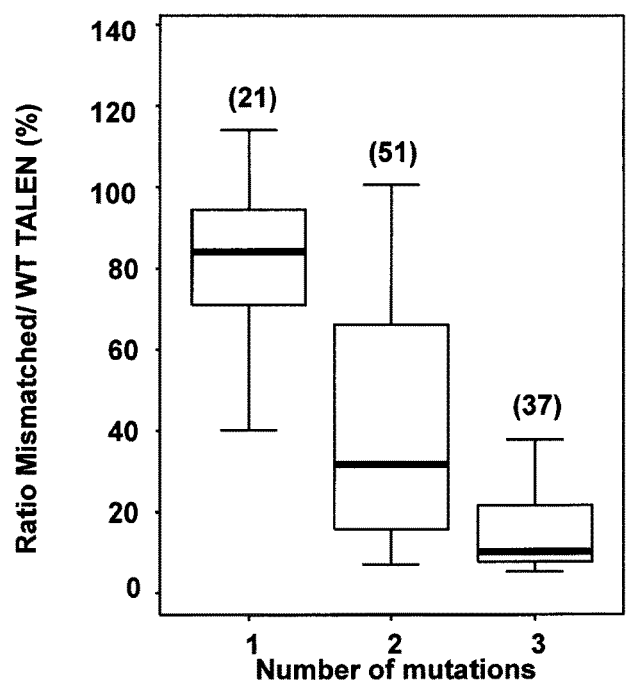
Figure 11D:
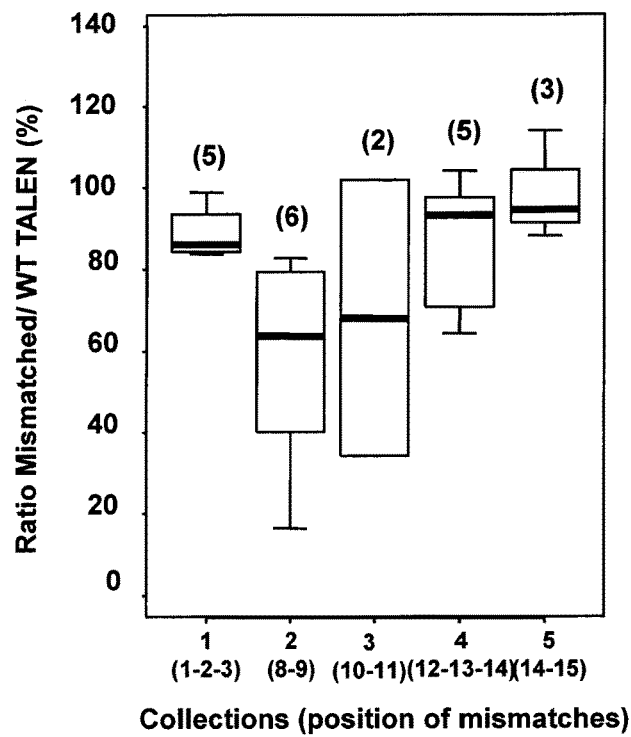
Figure 11E:
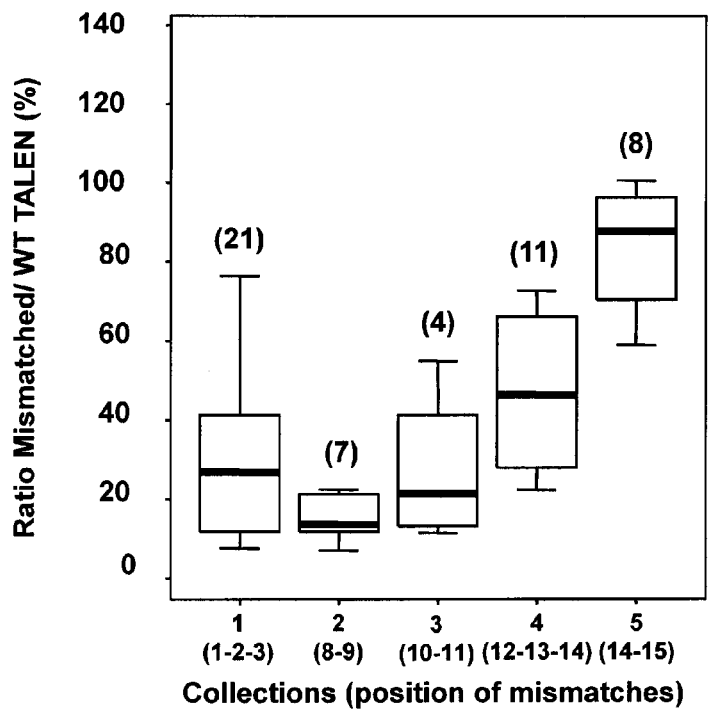
Figure 11F:
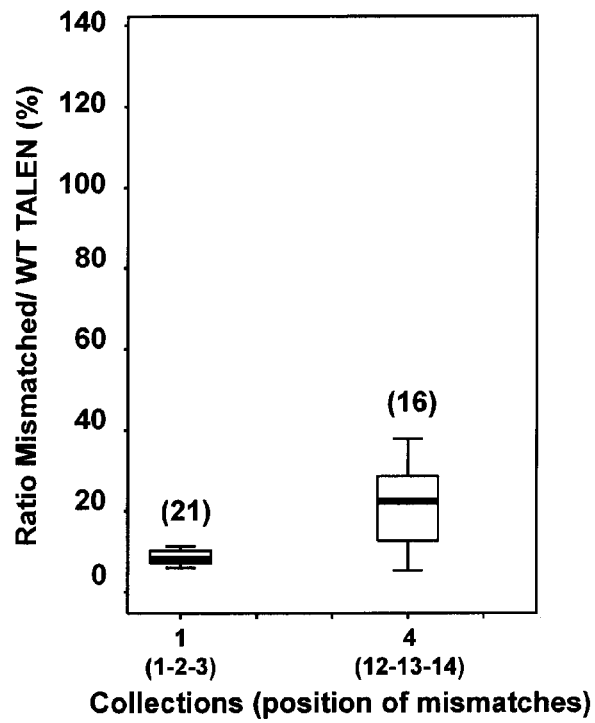

FIGS. 11A, B, C, D, E, and F: Gene disruption relative activities of collection of TALE-nuclease at the integrated GFP locus. (A) Schematic representation of the WT GFP TALE-nuclease on the chromosomal target. (B) Collections of TALE used at the chromosomal GFP locus. X representing any of the four NI, HD, NN and NG RVD. Positions are numbered relative to the first thymine of the target (T0). (C) Influence of the number of mismatches on the GFP disruption. Activity ratio between the mismatched and the WT TALE-nuclease are represented on a boxplot indicating the median (thick bar), quartiles (box) and extreme values (r=−0.68, p=3.7e-16). Mismatches are defined relative to the NI:A, HD:C, NN:G and NG:T association. The size of the sampling is indicated in brackets. (D) Boxplot representation, including the median (thick bar), quartiles (box) and extreme values, of the activity ratio between the mismatched and the WT TALE-nuclease in function of the collections for 1 mismatch. p=0.077. (E) Same as for (D) but for 2 mismatches. p=1e-05. (F) Same as for (D) but for 3 mismatches. p=0.00017.

Figure 12:
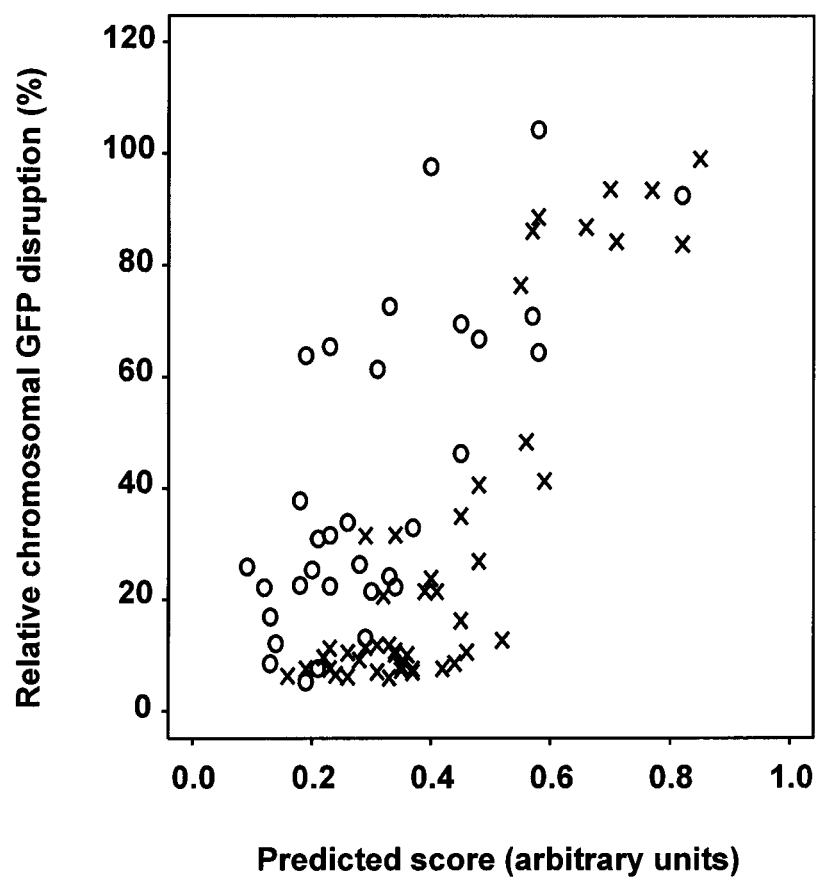

FIG. 12: Effect of target mismatches on TALE-nuclease activity in mammalian cells. Correlation between experimental relative activities represented by the percentage of GFP negative cells in the in the mammalian gene targeting assay and prediction using the matrices presented in FIG. 3 (TALE-nuclease/target associations containing mismatches in the 1/2/3 window are represented by crossed and TALE-nuclease/target associations containing mismatches in the 12/13/14 are represented by circles).

DETAILED DESCRIPTION OF THE INVENTION

TALE Domains

In the following, the present invention more particularly relate to engineered TALE proteins, which means proteins that comprises a nucleic acid binding domain (TALE domain) formed by the artificial assembly of modular domains.

These modular domains each have an affinity with respect to one nucleic acid base of a nucleic acid sequence to target. Such modular domains are generally TALE repeats deriving from to the transcription activator-like (TAL) effector family of proteins. The representative type member of this effector family is AvrBs3. Hence, the TAL effector family is also named AvrBs3-like family of proteins. Both expressions are used synonymously and can be interchanged. Non-limiting examples of the AvrBs3-like family are as follows: AvrBs4 and the members of the Hax sub-family Hax2, Hax3, and Hax4 as well as BrgI 1. AvrBs3-like family and homologous effectors typically have in their C-terminal region nuclear localization sequences (NLS) and a transcriptional activation domain (AD). The central region contains the TALE binding domain, which is composed of repeat units of typically 34 or 35 amino acids. The repeat units are nearly identical, but variable at positions 12 and 13 (variable diresidues). It was shown for AvrBs3 that the repeat units are responsible for binding to DNA, whereas the variable di-residues in positions 12 and 13 (RVDs) determine most of their specificity.

According to the invention, TALE domains are composed of AvrBs3-like repeats. However it may also include other modular polypeptides from other origins having an affinity to a nucleic acid base. RVDs designate here any such modular polypeptide, the affinity of which to a nucleic acid base is determined by a variable amino acid di-residue. For sake of simplicity, the modular polypeptide is referred to by said variable di-residue. Said RVDs have preferably an identity of at least 35%, 40%, 50%, 60%, 70%, 75%, 80%, 85%, 90% or 95% with the typical consensus sequences of AvrBs3 of respectively 34 amino acids presented by SEQ ID NO. 2

In preferred embodiments, amino acids in positions 4, 11, 24, and 32 of these consensus sequences are altered.

The number of RVDs to be used in a repeat domain can be ascertained by one skilled in the art by routine experimentation. Generally, at least 1.5 repeat units are considered as a minimum, although typically at least about 9 RVDs will be used. The RVDs do not have to be complete RVDs, as RVDs of half the size can be used. Moreover, the methods and polypeptides disclosed herein do depend on repeat domains with a particular number of RVDs. Thus, a polypeptide of the invention can comprise, for example, 8, 8.5, 9, 9.5, 10, 10.5, 11, 11.5, 12, 12.5, 13, 13.5, 14, 14.5, 15, 15.5, 16, 16.5, 17, 17.5, 18, 18.5, 19, 19.5, 20, 20.5, 21, 21.5, 22, 22.5, 23, 23.5, 24, 24.5, 25, 25.5, 26, 26.5, 27, 27.5, 28, 28.5, 29, 29.5, 30, 30.5, 31, 31.5, 32, 32.5, 33, 33.5, 34, 34.5, 35, 35.5, 36, 36.5, 37, 37.5, 38, 38.5, 39, 39.5, 40, 40.5, 41, 41.5, 42, 42.5, 43, 43.5, 44, 44.5, 46, 46.5, 47, 47.5, 48, 48.5, 49, 49.5, 50, 50.5 or more RVDs. The number and order of RVDs will determine the corresponding activity and DNA recognition specificity. As further examples, the AvrBs3 family members Hax2 includes 21.5 RVDs, Hax3 11.5 RVDs and Hax4 14.5 RVDs. Preferably, a polypeptide of the invention comprises about 8 and to about 39 RVDs. More preferably, a polypeptide of the invention comprises about 9.5 to about 33.5 RVDs.

In preferred embodiments of the invention, RVDs of the protein family AvrBs3 are used. The RVDs determine the recognition of one base pair on a DNA sequence. Hence, the sequence of RVDs correlates with a specific linear order of base pairs in a nucleic acid target sequence. The discovery of this core principle provides a powerful tool to customize TALE domains with respect to cognate target DNA template for a variety of applications including, but not limited to, modulation of gene expression and targeted genome engineering.

The modular architecture of the TALE domain and the recognition code identified by the inventors for targeting DNA with modulated specificity allows the efficient design of specific DNA-binding domains for use in a variety of technological fields. In particular, any polypeptide having an enzymatic activity on nucleic acids can be modified by being combined with a modular RVD DNA-binding domain of the present invention in order to direct its activity to a given genomic locus. Such examples include polypeptides that are transcription activator and repressor proteins, resistance-mediating proteins, nucleases, topoisomerases, ligases, integrases, recombinases, resolvases, methylases, acetylases, demethylases, deacetylases, and any other polypeptide capable of modifying DNA or RNA.

The present invention aims more particularly to improve the targeting specificity of TALE proteins fused to catalytic domains. Catalytic domains that may be fused to TALE binding domains can be selected, for instance, from the group consisting of proteins MmeI, Colicin-E7 (CEA7_ECOLX), EndA, Endo I (END1_ECOLI), Human Endo G (NUCG_HUMAN), Bovine Endo G (NUCG_BOVIN), R.HinP1I, I-BasI, I-BmoI, I-HmuI, I-Tev-I, I-TevII, I-TevIII, I-TwoI, R.MspI, R.MvaI, NucA, NucM, Vvn, Vvn_CLS, Staphylococcal nuclease (NUC_STAAU), Staphylococcal nuclease (NUC_STAHY), Micrococcal nuclease (NUC_SHIFL), Endonuclease yncB, Endodeoxyribonuclease I (ENRN_BPT7), Metnase, Nb.BsrDI, BsrDI A, Nt.BspD6I (R.BspD6I large subunit), ss.BspD6I (R.BspD6I small subunit), R.PleI, MlyI, AlwI, Mva1269I, BsrI, BsmI, Nb.BtsCI, Nt.BtsCI, R1.BtsI, R2.BtsI, BbvCI subunit 1, BbvCI subunit 2, Bpu10I alpha subunit, Bpu10I beta subunit, BmrI, BfiI, I-CreI, hExoI (EXO1_HUMAN), Yeast ExoI (EXO1_YEAST), E. coli ExoI, Human TREX2, Mouse TREX1, Human TREX1, Bovine TREX1, Rat TREX1, Human DNA2, Yeast DNA2 (DNA2_YEAST), VP16, RBBP8 and Type IIS nucleases like Fok-I.

The catalytic domain is preferably a nuclease domain, like for instance I-Tev-I, Col E7, NucA and Fok-I to form monomeric or dimeric TALE-nucleases. Such TALE-nucleases are more particularly used to introduce modifications into cell lines at genetic locus by nucleic acid cleavage. Methods for synthesizing TALE-nucleases more especially deriving from AvrBs3 and the uses thereof are extensively described in the prior art and well known by one skilled in the art.

Alternative Code

From the inventors's experimental work, it has been established that the main RVDs NI, NG, HD or NN found in nature have overall affinity with any of the four more common bases A, T, C, G, although those displaying different level of specificity one to each other. As a result, more possibilities are made available than previously expected by the prior art to assemble RVDs into TALE binding domains in order to target one nucleic acid sequence. The invention thus provides with means to target a larger number of nucleic acid sequences by using alternative, improved or degenerated RVD sequences. In particular, the invention provides with the use of the alternative RVDs:
-NI to target T;
-NI, HD or NG to target G.

Other alternative RVDs different from NI, HD, NG and NN may be used according to the invention.

Alternative RVDs are generally defined as having lower specificity with respect to a nucleic acid base than a standard RVD. Standard RVDs are defined are those RVDs generally used for obtaining optimal binding of a TALE domain according to an established code. For instance, according to the code established by Moscou and Bogdanove and similarly by Boch et al. with respect to AvrBs3, NI is a standard RVD for A, NG is a standard RVD for T, HD is a standard RVD for C, NN is a standard RVD for G. RVDs may be standard for two different nucleic acid basis, provided that their specificity is optimal for these two nucleic acid bases.

Further standard RVDs may be used according to the invention, in particular as follows:
-NI or NS to target A
-NG, HG, or IG to target T
-HD, HA, ND or HI to target C
-NN, NK, HN or NA to target G According to one aspect of the invention, alternative RVDs can be used to reduce the specificity of a TALE protein for its cognate nucleic acid target, thereby enlarging the number of nucleic acid target sequences that can be potentially targeted.

According to one embodiment of the invention, only a limited subset of RVDs are used to target the entire nucleic acid target sequence, which is advantageous in terms of manufacturing of the TALE proteins, since only a limited variety of RVDs need to be assembled. Preferably this subset only comprises less than 6, more preferably 4 or less than 4 RVDs, like for instance NI, NG, HD or NN, even more preferably 3 RVDs. Triplets RVDs may also be formed by using only two types of RVDs for targeting nucleic acid base triplets.

As a another embodiment, at least 1, preferably 2 alternative RVDs, are introduced into a pre-designed TALE domain in order to modulate its targeting specificity with respect to a target sequence. This allows further customization of TALE domain in order to target, or avoid targeting, for instance, homologous nucleic acid sequences that display sequence variability in a genome.

The present invention thus provides with a method for synthesizing a polynucleotide sequence encoding a transcription activator-like effector (TALE) protein, said protein having alternative targeting specificity towards a nucleic acid target sequence containing nucleic acid bases T and/or G, wherein said method comprises assembling at least 9 polynucleotide sequences encoding RVDs, each RVD having specificity to a nucleic acid base in said nucleic acid target, and wherein at least one of said 9 RVDs is selected among the alternative RVDs:
-NI to target T;
-NI, HD or NG to target G.

By synthesizing RVD triplets, the inventors have found that introducing alternative RVDs, especially -NI to target T and -NI, HD or NG to target G in RVD triplets resulted into better targeting efficiency of TALE proteins, in particular TALE-nucleases. The resulting alternative triplets and their cognate nucleic acid base triplets are detailed in Table 3.

Furthermore, as shown in Table 4, it appears that using alternative RVDs, NG and/or NN instead of standard RVDs NI and HD, to respectively target nucleic acid bases A and C, mostly resulted into better targeting specificity of the overall TALE domain. This was more particularly observed when A and/or C are located in positions 1, 2 or 3 of the nucleic acid target. Thus, according to a preferred embodiment of the invention, NG and/or NN can be introduced into the RVD sequence of said TALE protein to target A and/or C in position 1, 2 and/or 3 in the target sequence as provided in Table 5. More preferably, NG and/or NN are introduced in the RVD sequence to target A and/or C in position 1 or 2 or the target sequence.

The invention also encompasses the polynucleotides obtainable by the methods disclosed above encoding TALE proteins comprising at least one alternative RVD, or at least one RVD triplet as respectively disclosed in Table 3 and 5. Such polynucleotides may be cloned into appropriate expression vectors and expressed into cells to obtain the recombinant activator-like effector (TALE) protein of the invention.

Conversely, based on the above findings, the present invention also provides with a method for synthesizing a nucleic acid target sequence targetable by a transcription activator-like effector (TALE) protein having a RVD sequence containing at least HD, NG or NI, wherein each base of said target sequence is respectively selected to target said RVDs of said transcription activator-like effector (TALE) protein, and wherein said targetable sequence is chosen to comprise at least one base selected among:
T in order to contact NI, and/or
G in order to contact NI, HD or NG.

The resulting nucleic acid targets sequences can comprise at least one nucleic acid base triplets as indicated in Table 3 and/or in Table 5.

Such sequences, under numerical format, may be computed as part of a search for genomic sequences targetable by a given TALE sequence.

Method for Predicting and/or Modeling Targeting Specificity

As an advantage of the present invention, targeting specificity can be predicted or modeled by following the method presented in the present application, where all possible combinations of a limited subset of RVDs, preferably NI, NG, HD and NN are tested versus a subset of nucleic acid bases, preferably A, T, C and G.

Targeting specificity with respect to RVD substitution can be tested in a TALE sequence of reference, by successively substituting the different RVDs at different positions in this sequence with an alternative RVD. The targeting specificity may be measured, for instance, by fusion of the resulting various sequences with a nuclease domain, preferably Fok-1, using SSA assays as detailed in the examples.

The obtained results, which may take into account the positioning of the RVDs within the TALE sequences, are then used to calculate a targeting specificity score for each RVD with respect to each base position. This targeting specificity score generally corresponds to a ratio between the targeting specificity result obtained with the standard RVD and that obtain with the different alternative RVDs. According to a preferred embodiment of the invention the targeting specificity score is then placed into at least one matrix as represented in FIG. 3. Such matrix is (are) useful, when completed, to calculate the overall targeting specificity score for whole defined RVD sequences.

By following this method, a targeting specificity score can be calculated for any RVD sequence with respect to any nucleic acid target sequence. The calculation step may be advantageously performed by an appropriate computer program.

Conversely, the method of the invention allows identifying nucleic acid target sequences putatively recognized by one given RVD sequence by listing and ranking such sequences according to their targeting specificity score. Such putative nucleic acid target sequences may then be retrieved into genomes, for instance by computer searching in sequences databases.

The invention is thus directed to a method for identifying, and optionally ranking various RVD sequences with respect to one target sequence according to their targeting specificity, wherein said method is based on a prediction of targeting specificity calculated using a matrix providing with a targeting specificity score for each RVD with respect to each base position along the nucleic acid target sequence. In a preferred embodiment, said method involves targeting specificity scores obtainable by at least testing the association between one base with a standard and a alternative RVD, preferably under the form of a TALE-nuclease molecule, more preferably using SSA assay. In a more preferred embodiment the targeting specificity score is determined according to the positioning of said RVDs within the RVD sequence. The targeting specificity score preferably results from a ratio between the targeting specificity obtained with each RVD with respect to each nucleic acid base and the targeting specificity obtained using a reference optimal RVD code, such as:

-NI to target A
-NG to target T
-HD to target C
-NN to target G.

Upon identification, synthesis or selection of proper RVD sequences according to the invention, it is possible to fuse said RVD sequences with catalytic domains in order to develop, for instance, transcriptional regulators or TALE-nucleases with a modulated and/or predicted specificity. With respect to TALE-nuclease, these can be used to introduce genetic modifications into a cell genome, especially by facilitating the insertion of nucleic acids sequences through homologous recombination. By example, modulating the targeting specificity of such TALE-nuclease makes it easier to target homologous gene sequences using the same RVD sequence.

Other Definitions

Amino acid residues in a polypeptide sequence are designated herein according to the one-letter code, in which, for example, Q means Gln or Glutamine residue, R means Arg or Arginine residue and D means Asp or Aspartic acid residue.

Amino acid substitution means the replacement of one amino acid residue with another, for instance the replacement of an Arginine residue with a Glutamine residue in a peptide sequence is an amino acid substitution.

DNA or nucleic acid processing activity refers to a particular or given enzymatic activity conferred by a catalytic domain onto the nucleic acid structure or onto the expression of genes, directly on indirectly. Said DNA or nucleic acid processing activity can refer to a cleavage activity, either a cleavase activity either a nickase activity, more broadly a nuclease activity but also a polymerase activity, a transcriptional activity, a kinase activity, a phosphatase activity, a methylase activity, a topoisomerase activity, an integrase activity, a transposase activity, a ligase, a helicase or recombinase activity as non-limiting examples.

Nucleic acid bases are designated as follows: one-letter code is used for designating the base of a nucleoside: a is adenine, t is thymine, c is cytosine, and g is guanine. For the degenerated nucleotides, r represents g or a (purine nucleotides), k represents g or t, s represents g or c, w represents a or t, m represents a or c, y represents t or c (pyrimidine nucleotides), d represents g, a or t, v represents g, a or c, b represents g, t or c, h represents a, t or c, and n represents g, a, t or c. by "exogenous sequence" it is intended to mean a DNA construct comprising a first and second portion that are homologous to regions 5' and 3' of a DNA target in situ. The DNA construct also comprises a third portion positioned between the first and second portion which comprise some homology with the corresponding DNA sequence in situ or alternatively comprise no homology with the regions 5' and 3' of the DNA target in situ. Following cleavage of the DNA target, a homologous recombination event is stimulated between the genome containing the targeted gene comprised in the locus of interest and the repair matrix, wherein the genomic sequence containing the DNA target is replaced by the third portion of the repair matrix and a variable part of the first and second portions of the repair matrix. by "DNA target", "DNA target sequence", "target DNA sequence", "nucleic acid target sequence", "target sequence", is intended a polynucleotide sequence which can be bound by the TALE DNA binding domain that is included in the proteins of the present invention. It refers to a specific DNA location, preferably a genomic location in a cell, but also a portion of genetic material that can exist independently to the main body of genetic material such as plasmids, episomes, virus, transposons or in organelles such as mitochondria or chloroplasts as non-limiting examples. The nucleic acid target sequence is defined by the 5' to 3' sequence of one strand of said target, as indicated for SEQ ID NO: 83 to 89 in table 3 as a non-limiting example. Generally, the DNA target is adjacent or in the proximity of the locus to be processed either upstream (5' location) or downstream (3' location). In a preferred embodiment, the target sequences and the proteins are designed in order to have said locus to be processed located between two such target sequences. Depending on the catalytic domains of the proteins, the target sequences may be distant from 5 to 50 bases (bp), preferably from 10 to 40 bp, more preferably from 15 to 30, even more preferably from 15 to 25 bp. These later distances define the spacer referred to in the description and the examples. It can also define the distance between the target sequence and the nucleic acid sequence being processed by the catalytic domain on the same molecule.

By "targeting specificity" is meant the efficiency of obtaining processing of nucleic acid sequences at the locus or adjacent to the locus targeted by the TALE sequence by genetic expression of the nucleic acid sequences or physical modification thereof. This processing is generally obtained through the catalytic domain to which the TALE sequence is fused to form a TALE protein. This efficiency can be measured by different means. When the catalytic domain has a nuclease activity (TALE-nuclease) targeting specificity can be assessed by measuring cleavage activity through SSA assays, as illustrated in the experimental part of the present application. When the catalytic domain is a transcriptional activator, targeting specificity can be measured through the activation of a reporter gene encoding GFP or Beta-galactosidase.

By "delivery vector" or "delivery vectors" is intended any delivery vector which can be used in the present invention to put into cell contact (i.e "contacting") or deliver inside cells or subcellular compartments agents/chemicals and molecules (proteins or nucleic acids) needed in the present invention. It includes, but is not limited to liposomal delivery vectors, viral delivery vectors, drug delivery vectors, chemical carriers, polymeric carriers, lipoplexes, polyplexes, dendrimers, microbubbles (ultrasound contrast agents), nanoparticles, emulsions or other appropriate transfer vectors. These delivery vectors allow delivery of molecules, chemicals, macromolecules (genes, proteins), or other vectors such as plasmids, peptides developed by Diatos. In these cases, delivery vectors are molecule carriers. By "delivery vector" or "delivery vectors" is also intended delivery methods to perform transfection.

-"vector" or "vectors" refer to a nucleic acid molecule capable of transporting another nucleic acid to which it has been linked. A "vector" in the present invention includes, but is not limited to, a viral vector, a plasmid, a RNA vector or a linear or circular DNA or RNA molecule which may consists of a chromosomal, non chromosomal, semi-synthetic or synthetic nucleic acids. Preferred vectors are those capable of autonomous replication (episomal vector) and/or expression of nucleic acids to which they are linked (expression vectors). Large numbers of suitable vectors are known to those of skill in the art and commercially available. One type of preferred vector is an episome, i.e., a nucleic acid capable of extra-chromosomal replication. Preferred vectors are those capable of autonomous replication and/or expression of nucleic acids to which they are linked. Vectors capable of directing the expression of genes to which they are operatively linked are referred to herein as "expression vectors. A vector according to the present invention comprises, but is not limited to, a YAC (yeast artificial chromosome), a BAC (bacterial artificial), a baculovirus vector, a phage, a phagemid, a cosmid, a viral vector, a plasmid, a RNA vector or a linear or circular DNA or RNA molecule which may consist of chromosomal, non chromosomal, semi-synthetic or synthetic DNA. In general, expression vectors of utility in recombinant DNA techniques are often in the form of "plasmids" which refer generally to circular double stranded DNA loops which, in their vector form are not bound to the chromosome. Large numbers of suitable vectors are known to those of skill in the art. Vectors can comprise selectable markers, for example: neomycin phosphotransferase, histidinol dehydrogenase, dihydrofolate reductase, hygromycin phosphotransferase, herpes simplex virus thymidine kinase, adenosine deaminase, glutamine synthetase, and hypoxanthine-guanine phosphoribosyl transferase for eukaryotic cell culture; TRP1 for *S. cerevisiae*; tetracyclin, rifampicin or ampicillin resistance in *E. coli*. Preferably said vectors are expression vectors, wherein a sequence encoding a polypeptide of interest is placed under control of appropriate transcriptional and translational control elements to permit production or synthesis of said polypeptide. Therefore, said polynucleotide is comprised in an expression cassette. More particularly, the vector comprises a replication origin, a promoter operatively linked to said encoding polynucleotide, a ribosome binding site, a RNA-splicing site (when genomic DNA is used), a polyadenylation site and a transcription termination site. It also can comprise an enhancer or silencer elements. Selection of the promoter will depend upon the cell in which the polypeptide is expressed. Suitable promoters include tissue specific and/or inducible promoters. Examples of inducible promoters are: eukaryotic metallothionine promoter which is induced by increased levels of heavy metals, prokaryotic lacZ promoter which is induced in response to isopropyl-β-D-thiogalacto-pyranoside (IPTG) and eukaryotic heat shock promoter which is induced by increased temperature. Examples of tissue specific promoters are skeletal muscle creatine kinase, prostate-specific antigen (PSA), α-antitrypsin protease, human surfactant (SP) A and B proteins, β-casein and acidic whey protein genes. Delivery vectors and vectors can be associated or combined with any cellular permeabilization techniques such as sonoporation or electroporation or derivatives of these techniques.

Viral vectors include retrovirus, adenovirus, parvovirus (e. g. adeno-associated viruses), coronavirus, negative strand RNA viruses such as orthomyxovirus (e. g., influenza virus), rhabdovirus (e. g., rabies and vesicular stomatitis virus), paramyxovirus (e. g. measles and Sendai), positive strand RNA viruses such as picornavirus and alphavirus, and double-stranded DNA viruses including adenovirus, herpesvirus (e. g., Herpes Simplex virus types 1 and 2, Epstein-Barr virus, cytomega-lovirus), and poxvirus (e. g., vaccinia, fowlpox and canarypox). Other viruses include Norwalk virus, togavirus, flavivirus, reoviruses, papovavirus, hepadnavirus, and hepatitis virus, for example. Examples of retroviruses include: avian leukosis-sarcoma, mammalian C-type, B-type viruses, D type viruses, HTLV-BLV group, lentivirus, spumavirus (Coffin, J. M., Retroviridae: The viruses and their replication, In Fundamental Virology, Third Edition, B. N. Fields, et al., Eds., Lippincott-Raven Publishers, Philadelphia, 1996).

By "lentiviral vector" is meant HIV-Based lentiviral vectors that are very promising for gene delivery because of their relatively large packaging capacity, reduced immunogenicity and their ability to stably transduce with high efficiency a large range of different cell types. Lentiviral vectors are usually generated following transient transfection of three (packaging, envelope and transfer) or more plasmids into producer cells. Like HIV, lentiviral vectors enter the target cell through the interaction of viral surface glycoproteins with receptors on the cell surface. On entry, the viral RNA undergoes reverse transcription, which is mediated by the viral reverse transcriptase complex. The product of reverse transcription is a double-stranded linear viral DNA, which is the substrate for viral integration in the DNA of infected cells.

By "integrative lentiviral vectors (or LV)", is meant such vectors as non limiting example, that are able to integrate the genome of a target cell.

At the opposite by "non integrative lentiviral vectors (or NILV)" is meant efficient gene delivery vectors that do not integrate the genome of a target cell through the action of the virus integrase.

By cell or cells is intended any prokaryotic or eukaryotic living cells, cell lines derived from these organisms for in vitro cultures, primary cells from animal or plant origin.

By "primary cell" or "primary cells" are intended cells taken directly from living tissue (i.e., biopsy material) and established for growth in vitro, that have undergone very few population doublings and are therefore more representative of the main functional components and characteristics of tissues from which they are derived from, in comparison to continuous tumorigenic or artificially immortalized cell lines. These cells thus represent a more valuable model to the in vivo state they refer to.

In the frame of the present invention, "eukaryotic cells" refer to a fungal, plant or animal cell or a cell line derived from the organisms listed below and established for in vitro culture. More preferably, the fungus is of the genus *Aspergillus, Penicillium, Acremonium, Trichoderma, Chrysoporium, Mortierella, Kluyveromyces* or *Pichia*; More preferably, the fungus is of the species *Aspergillus niger, Aspergillus nidulans, Aspergillus oryzae, Aspergillus tereus, Penicillium chrysogenum, Penicillium citrinum, Acremonium Chrysogenum, Trichoderma reesei, Mortierella alpine, Chrysosporium lucknowense, Kluyveromyces lactis, Pichia pastoris* or *Pichia ciferri*. More preferably the plant is of the genus *Arabidospis, Nicotiana, Solanum, Iactuca, Brassica, Oryza, Asparagus, Pisum, Medicago, Zea, Hordeum, Secale, Triticum, Capsicum, Cucumis, Cucurbita, Citruffis, Citrus, Sorghum*; More preferably, the plant is of the species *Arabidospis thaliana, Nicotiana tabaccum, Solanum lycopersicum, Solanum tuberosum, Solanum melongena, Solanum esculentum, Lactuca saliva, Brassica napus, Brassica oleracea, Brassica rapa, Oryza glaberrima, Oryza sativa, Asparagus officinalis, Pisum sativum, Medicago sativa, zea mays, Hordeum vulgare, Secale cereal, Triticum aestivum, Triticum durum, Capsicum sativus, Cucurbita pepo, Citrullus lanatus, Cucumis melo, Citrus aurantifolia, Citrus maxima, Citrus medica, Citrus reticulata*.

More preferably the animal cell is of the genus Homo, *Rattus, Mus, Sus, Bos, Danio, Canis, Felis, Equus, Salmo, Oncorhynchus, Gallus, Meleagris, Drosophila, Caenorhabditis*; more preferably, the animal cell is of the species *Homo sapiens, Rattus norvegicus, Mus musculus, Sus scrofa, Bos taurus, Danio rerio, Canis lupus, Felis catus, Equus caballus, Salmo salar, Oncorhynchus mykiss, Gallus gallus, Meleagris gallopavo, Drosophila melanogaster, Caenorhabditis elegans*.

In the present invention, the cell can be a plant cell, a mammalian cell, a fish cell, an insect cell or cell lines derived from these organisms for in vitro cultures or primary cells taken directly from living tissue and established for in vitro culture. As non limiting examples cell lines can be selected from the group consisting of CHO-K1 cells; HEK293 cells; Caco2 cells; U2-OS cells; NIH 3T3 cells; NSO cells; SP2 cells; CHO-S cells; DG44 cells; K-562 cells, U-937 cells; MRC5 cells; IMR90 cells; Jurkat cells; HepG2 cells; HeLa cells; HT-1080 cells; HCT-116 cells; Hu-h7 cells; Huvec cells; Molt 4 cells. All these cell lines can be modified by the method of the present invention to provide cell line models to produce, express, quantify, detect, study a gene or a protein of interest; these models can also be used to screen biologically active molecules of interest in research and production and various fields such as chemical, biofuels, therapeutics and agronomy as non-limiting examples.

By "mutation" is intended the substitution, deletion, insertion of one or more nucleotides/amino acids in a polynucleotide (cDNA, gene) or a polypeptide sequence. Said mutation can affect the coding sequence of a gene or its regulatory sequence. It may also affect the structure of the genomic sequence or the structure/stability of the encoded mRNA.

In the frame of the present invention, the expression "double-strand break-induced mutagenesis" (DSB-induced mutagenesis) refers to a mutagenesis event consecutive to an NHEJ event following an endonuclease-induced DSB, leading to insertion/deletion at the cleavage site of an endonuclease.

By "gene" is meant the basic unit of heredity, consisting of a segment of DNA arranged in a linear manner along a chromosome, which codes for a specific protein or segment of protein. A gene typically includes a promoter, a 5' untranslated region, one or more coding sequences (exons), optionally introns, a 3' untranslated region. The gene may further comprise a terminator, enhancers and/or silencers.

As used herein, the term "locus" is the specific physical location of a DNA sequence (e.g. of a gene) on a chromosome. The term "locus" usually refers to the specific physical location of a polypeptide or chimeric protein's nucleic target sequence on a chromosome. Such a locus can comprise a target sequence that is recognized and/or cleaved by a polypeptide or a chimeric protein according to the invention. It is understood that the locus of interest of the present invention can not only qualify a nucleic acid sequence that exists in the main body of genetic material (i.e. in a chromosome) of a cell but also a portion of genetic material that can exist independently to said main body of genetic material such as plasmids, episomes, virus, transposons or in organelles such as mitochondria or chloroplasts as non-limiting examples.

By "fusion protein" is intended the result of a well-known process in the art consisting in the joining of two or more genes which originally encode for separate proteins or part of them, the translation of said "fusion gene" resulting in a single polypeptide with functional properties derived from each of the original proteins.

By "chimeric protein" according to the present invention is meant any fusion protein comprising at least one RVD to target a nucleic acid sequence and one protein domain to process a nucleic acid target sequence within or adjacent to said bound nucleic acid sequence.

By "protein domain" is meant the nucleic acid target sequence processing part of said chimeric protein according to the present invention. Said protein domain can provide any catalytical activity (catalytic domain) as classified and named according to the reaction they catalyze [Enzyme Commission number (EC number) at http://www-.chem.qmul.ac.uk/iubmb/enzyme/)]. Said protein domain can be a catalytically active entity by itself. Said protein domain can be a protein subdomain that needs to interact with another protein subdomain to form a dimeric protein domain active entity.

By a "TALE-nuclease" (TALEN) is intended a fusion protein consisting of a DNA-binding domain derived from a Transcription Activator Like Effector (TALE) and one nuclease catalytic domain to cleave a nucleic acid target sequence. Said TALE-nuclease is a subclass of chimeric protein according to the present invention. Such engineered TAL-nucleases are commercially available under the trade name TALEN™ (Cellectis, 8 rue de la Croix Jarry, 75013 Paris, France).

By "variant(s)", it is intended a RVD variant, a chimeric protein variant, a DNA binding variant, a TALE-nuclease variant, a polypeptide variant obtained by replacement of at least one residue in the amino acid sequence of the parent molecule.

By "functional mutant" is intended a catalytically active mutant of a protein or a protein domain; such mutant can have the same activity compared to its parent protein or protein domain or additional properties. This definition applies to chimeric proteins or protein domains that constitute chimeric proteins according to the present invention.

Are also encompassed in the scope of this definition "derivatives" of these proteins or protein domains that comprise the entirety or part of these proteins or protein domains fused to other proteic or chemical parts such as tags, antibodies, polyethylene glycol as non-limiting examples.

"identity" refers to sequence identity between two nucleic acid molecules or polypeptides. Identity can be determined by comparing a position in each sequence which may be aligned for purposes of comparison. When a position in the compared sequence is occupied by the same base, then the molecules are identical at that position. A degree of similarity or identity between nucleic acid or amino acid sequences is a function of the number of identical or matching nucleotides at positions shared by the nucleic acid sequences. Various alignment algorithms and/or programs may be used to calculate the identity between two sequences, including FASTA, or BLAST which are available as a part of the GCG sequence analysis package (University of Wisconsin, Madison, Wis.), and can be used with, e.g., default setting. Unless otherwise stated, the present invention encompasses polypeptides and polynucleotides sharing at least 70%, generally at least 80%, more generally at least 85%, preferably at least 90%, more preferably at least 95% and even more preferably at least 97% with those described herein.

The above written description of the invention provides a manner and process of making and using it such that any person skilled in this art is enabled to make and use the same, this enablement being provided in particular for the subject matter of the appended claims, which make up a part of the original description.

As used above, the phrases "selected from the group consisting of," "chosen from," and the like include mixtures of the specified materials.

Where a numerical limit or range is stated herein, the endpoints are included. Also, all values and subranges within a numerical limit or range are specifically included as if explicitly written out.

The above description is presented to enable a person skilled in the art to make and use the invention, and is provided in the context of a particular application and its requirements. Various modifications to the preferred embodiments will be readily apparent to those skilled in the art, and the generic principles defined herein may be applied to other embodiments and applications without departing from the spirit and scope of the invention. Thus, this invention is not intended to be limited to the embodiments shown, but is to be accorded the widest scope consistent with the principles and features disclosed herein.

Having generally described this invention, a further understanding can be obtained by reference to certain specific examples, which are provided herein for purposes of illustration only.

EXAMPLES

Example 1: Library Construction

To determine optimal TALE/targets pairs (in the context of a TALE-nuclease) an extensive characterization of the activity, in yeast, of any combination of a RVD, among the HD, NI, NN and NG code, with any of the four bases (A, T, C and G) was performed. The study was done on position 1/2/3 or 3/4/5 or 5/6/7 of various TALE-nuclease RVD array and targets.

Collection of TALE RVD Arrays Construction

The amino acid sequences of the N-terminal, C-terminal domains and RVDS were based on the AvrBs3 TALE (ref: GenBank: X16130.1, SEQ ID NO: 1). All RVD building block, according to the HD, NG, NI and NN RVD code (SEQ ID NO: 2 to 5), and RVD (or repeat) arrays, including starting material, were verified by DNA sequencing. The RVD arrays collections were synthesized using a solid support method composed of consecutive restriction/ligation/washing steps as shown in FIG. 1.

Collection A in Position 1/2/3

For this collection in position 1/2/3, the 64 possible tri-RVDs (SEQ ID NO: 6 to 69), were individually immobilized on a solid support. The desired building block containing RVD array A4 to A10 (SEQ ID NO: 70), prepared as described previously (FIG. 1), was ligated to each of the immobilized tri-RVD. The synthesized arrays (A1 to A10) were individually released from the solid support by enzymatic restriction and subcloned either in a shuttle plasmid or a yeast expression plasmid. When subcloned in a shuttle plasmid, the RVD arrays were subsequently subcloned into a yeast expression vector pCLS9944 (SEQ ID NO: 77).

Collection B in Position 3/4/5

For this collection in position 3/4/5, a di-RVD (SEQ ID NO: 71), prepared according as described previously, targeting bases B1 and B2 of the desired targets, was immobilized individually 64 times on a solid support. Each of the 64 possible tri-RVDs (SEQ ID NO: 6 to 69) were individually ligated to one of the pre immobilized di-RVD array leading to an immobilized 1 to 5 RVD array. After washing and restriction steps, a building block containing RVD array B6 to B10 (SEQ ID NO: 72), prepared according as described previously, was ligated to each of the immobilized nascent chain (RVD array B1 to B5). The synthesized arrays (B1 to B10) were individually released from the solid support by enzymatic restriction and subcloned into a yeast expression plasmid pCLS9944 (SEQ ID NO: 77).

Collection C in Position 5/6/7

For this collections in position 5/6/7, a tetra-RVD array (SEQ ID NO: 73), prepared according as described previously, targeting bases C1 to C4, was immobilized individually 64 times on a solid support. Each of the 64 possible tri-RVDs (SEQ ID NO: 6 to 69) were individually ligated to one of the pre immobilized tetra-RVD array leading to an immobilized 1 to 7 RVD array. After washing and restriction steps, a building block containing RVD array C8 to C10 (SEQ ID NO: 74), prepared as described previously, was ligated to each of the immobilized nascent chain (RVD array C1 to C7). The synthesized arrays (C1 to C10) were individually released from the solid support by enzymatic restriction and subcloned into a yeast expression plasmid pCLS9944 (SEQ ID NO: 77).

Collection D in Position 1/2/3

For this collection in position 1/2/3, the 64 possible tri-RVDs (SEQ ID NO: 6 to 69), were individually immobilized on a solid support. The desired building block containing RVD array D4 to D19 (SEQ ID NO: 75), prepared as described previously, was ligated to each of the immobilized tri-RVD. The synthesized arrays (D1 to D19) were individually released from the solid support by enzymatic restriction and subcloned into a yeast expression plasmid pCLS9944 (SEQ ID NO: 77).

Collection E in Position 1/2/3

For this collection in position 1/2/3, the 64 possible tri-RVDs (SEQ ID NO: 6 to 69), were individually immobilized on a solid support. The desired building block containing RVD array E4 to E14 (SEQ ID NO: 76), prepared as described previously, was ligated to each of the immobilized tri-RVD. The synthesized arrays (E1 to E14) were individually released from the solid support by enzymatic restriction and subcloned into a yeast expression plasmid pCLS9944 (SEQ ID NO: 77).

Collection G in Position 14/15

This collection in position 14 and 15 of a 16 RVDs (including the half terminal RVD) TALE-nuclease array is constructed using the solid support synthesis technology. The synthesized arrays (G1 to G16) were individually released from the solid support by enzymatic restriction and subcloned into a yeast expression plasmid pCLS9944 (SEQ ID NO: 77).

Collection H in Position 12/13/14

This collection in position 12, 13 and 14 of a 16 RVDs (including the half terminal RVD) TALE-nuclease array is constructed using the solid support synthesis technology. The synthesized arrays (H1 to H16) were individually released from the solid support by enzymatic restriction and subcloned into a yeast expression plasmid pCLS9944 (SEQ ID NO: 77).

Collection I in Position 10/11

This collection in position 10 and 11 of a 15.5 RVDs (including the half terminal RVD) TALE-nuclease array is constructed using the solid support synthesis technology. The synthesized arrays (I1 to I16) were individually released from the solid support by enzymatic restriction and subcloned into a yeast expression plasmid pCLS9944 (SEQ ID NO:77).

Collection J in Position 8/9

This collection in position 8 and 9 of a 15.5 RVDs (including the half terminal RVD) TALE-nuclease array is constructed using the solid support synthesis technology. The synthesized arrays (J1 to J16) were individually released from the solid support by enzymatic restriction and subcloned into a yeast expression plasmid pCLS9944 (SEQ ID NO:77).

Cloning of the RVD Array Collection in the TALE Backbone

The TALE backbone used in these experiment (pCLS9944, SEQ ID NO: 70) contains, between the C-terminal and the N-terminal domains, two BsmBI restriction sites. The individual clones of each collection of RVD arrays were subcloned in the pCLS9944 using type IIs restriction enzymes BsmBI for the receiving plasmid and BbvI and SfaNI for the inserted RVD sequence (directly from the solid support synthesis or from the shuttle plasmid). The monoclonality DNA sequence of each individual clone was assessed by DNA sequencing.

TALE-Nuclease Activities in Yeast

All the yeast target reporter plasmids containing the TALE-nuclease DNA target collection sequences were constructed as previously described (International PCT Applications WO 2004/067736 and in (Epinat, Arnould et al. 2003; Chames, Epinat et al. 2005; Arnould, Chames et al. 2006; Smith, Grizot et al. 2006). The collections of TALE-nuclease were tested at 37° C. and 30° C. in our yeast SSA assay previously described (International PCT Applications WO 2004/067736 and in (Epinat, Arnould et al. 2003; Chames, Epinat et al. 2005; Arnould, Chames et al. 2006; Smith, Grizot et al. 2006) as pseudo-palindromic sequences (two identical recognition sequences are placed facing each other on both DNA strands) on their target collections (Tables 1 and 2). TALE-nuclease cleavage activity (for a whole collection) levels on their complete collection of targets in yeast (Hitmaps) are shown on FIGS. 5 to 9.

Example 2: Differences Between the Published Standard Code and the Alternative Code Starting from the data published by Moscou and Bogdanove and similarly by Boch et al, we retained for each RVD NI, HD, NN or NG the two best recognized nucleotides. Thus, we retained A and C for NI, C and A for HD, G and A for NN, and T and C for NG. Then, for each collection of homodimeric TALE-nucleases mutated at 3 consecutive RVDs $R_1R_2R_3$ and their corresponding targets mutated at 3 consecutive nucleotides $N_1N_2N_3$, we looked at each combination TALE-nuclease+target $(R_1R_2R_3/N_1N_2N_3)$ that gave a signal but could not be explained by the above two best recognized nucleotides:

either at least one of the $R_i/N_i$ does not follow the two-best nucleotide rule (one position that does not comply to the code).

or at least two positions for which the $R_i/N_i$ do not follow the two-best nucleotide rule (two positions that do not comply to the code).

or all three positions for which the $R_i/N_i$ do not follow the two-best nucleotide rule (three positions that do not comply to the code).

For each category (one or two positions that do not follow the two-best nucleotide rule), the pairs $R_1R_2R_3/N_1N_2N_3$ that gave a positive signal are presented in table 3 and table 4.

Example 3: Off-Target Search Using an Averaged Matrix

An averaged matrix was computed, excluding datapoints corresponding to CAN and AAN at positions 123 was calculated using data from collection A, B and C. This average matrix was then thresholded at 0.6 so that only high intensity datapoints were kept.

To exemplify the strategy to find potential off-site target using these data, we took a given TALE-nuclease half binding site with the sequence TTGTCCCACAGATATC (SEQ ID NO: 78), the first T being the $T_0$. We then used the thresholded average matrix to find what are the nucleotide triplets recognized by NG-NN-NG, NG-NN-NG being the triRVD corresponding to the first three nucleotides just after the $T_0$. Then, using each one of the obtained triplets $N_1N_2N_3$, we looked at the possible subsequent $N_4$ nucleotides for which the triplet $N_2N_3N_4$ was recognized by the tri-RVD at the corresponding positions 2, 3 and 4 (here, NN-NG-HD) according to the matrix, collecting all 4-nucleotide $N_1N_2N_3N_4$ candidate target stretches. We iterated this procedure at each position 5, 6, . . . 15 until the end of the target is reached leading to a collection of potential 15-mer targets. Each 15 half-binding site candidate was attributed a score which was obtained by multiplying together the coefficients found in the matrix for the different pairs of tri RVDs and nucleotide triplets along the path corresponding to this target. This score between 0 and 1 allows to sort the candidates from the likeliest to be well cut to the ones that might be the most difficult to cut. The $T_0$ was added at the beginning of each candidate target to make a full candidate half-binding site. Off-site targets determined using this method with a target score above 0, 2 are ranked in table 3.

Example 4: Determination of RVD Composed DNA Binding Arrays Using an Averaged Matrix An averaged matrix was computed, excluding datapoints corresponding to CAN and AAN at positions 123 was calculated using data from collection A, B and C. This average matrix was then thresholded at 0.6 so that only high intensity datapoints were kept.

To exemplify the strategy to find potential TALE-nucleases for a specific target using these data, we took a given TALE-nuclease half target site with the sequence TTGTC-CCACAGATATC (SEQ ID NO: 78 and 79), the first T being the $T_0$. We then used the thresholded average matrix to find what are the RVD triplets recognizing T-G-T, T-G-T being the nucleotide triplets corresponding to the first three RVDs just after the $T_0$. Then, using each one of the obtained RVD triplets $R_1R_2R_3$, we looked at the possible subsequent $R_4$ RVD for which the triplet $R_2R_3R_4$ recognize the corresponding nucleotide triplet at positions 2, 3 and 4 (here, G-T-C) according to the matrix, collecting all 4-RVDs $R_1R_2R_3R_4$ candidate stretches. We iterated this procedure at each position 5, 6, . . . 15 until the end of the RVD binding domain is reached leading to a collection of potential 15-mer mutants. Each 15 half-binding mutant candidate was attributed a score which was obtained by multiplying together the coefficients found in the matrix for the different pairs of tri RVDs and nucleotide triplets along the path corresponding to this target. This score between 0 and 1 allows to sort the candidates from the likeliest cutter (binder) to the ones that might be the less active. RVD binding arrays determined using this method with a targeting specificity score above 0, 2 are ranked in table 7.

Example 5: Comparison of Predicted Off-Site Activities Using an Averaged Matrix with Experimental Data In this example, a collection of TALE-nucleases is assayed for activity on an endogenous locus. The collection is only on 1 TALE of the pair and in position 1/2/3.
Collection F in Position 1/2/3

For this collection in position 1/2/3, 50 possible tri-RVDs (SEQ ID NO: 6 to 14, 16 to 32, 34, 36, 37, 39 to 45, 50, 52, 54 to 60, 63, 64, 66, 67 and 69), were individually immobilized on a solid support. The desired building block containing RVD array F4 to F16 (SEQ ID NO: 80), prepared as described previously, was ligated to each of the immobilized tri-RVD. The synthesized arrays (F1 to F16) were individually released from the solid support by enzymatic restriction and subcloned, as previously described, into a mammalian expression plasmid pCLS8429 (SEQ ID NO: 81).

The RVD arrays (SEQ ID NO: 82) of the second TALE of the pair, targeting the desired sequences (SEQ ID NO: 83) was synthesized using a solid support method composed of consecutive restriction/ligation/washing steps as shown in FIG. 1. In brief the first block (coding for a di-RVD) was immobilized on a solid support through biotin/streptavidin interaction, the second bloc (tri-RVD) is then ligated to the first and after SfaNI digestion a third bloc (tri-RVD) is coupled. The process is repeated using tri- or di-RVD blocs upon obtaining of the desired RVD array. The product is cloned in a classical pAPG10 cloning plasmid for amplification in *E. coli* and sequencing. The RVD array was then subcloned, as previously described, in a mammalian expression plasmid, leading to pCLS9749 (SEQ ID NO: 84).
Endogenous (GFP) TALE-Nuclease Activity Assay CHO-KI cells containing the chromosomally integrated GFP reporter gene including the TALE-nuclease recognition sequence (SEQ ID NO: 85), were cultured at 37° C. with 5% $CO_2$ in F12-K complete medium supplemented with 2 mM I-glutamine, penicillin (100 IU/ml), streptomycin (100 µg/ml), amphotericin B (Fongizone: 0.25 µg/ml, Life Technologies) and 10% FBS. Cell transfection was performed according to the manufacturer's instructions using the Nucleofector apparatus (Amaxa, Cologne, Germany). Adherent CHO-KI cells were harvested at day 1 of culture, washed twice in phosphate-buffered saline (PBS), trypsinized, and resuspended in T nucleofection solution to a concentration of $1\times10^6$ cells/100 µL. 5 µg of each of the two TALE-nuclease expression vectors pair (10 µg final DNA amount) were mixed with 0.1 mL of the CHO-KI cell suspension, transferred to a 2.0-mm electroporation cuvette and nucleofected using program U23 of Amaxa Nucleofector apparatus. Maximum 20 min after nucleofection, 0.5 mL of prewarmed CHO-K1 medium was added to the electroporation cuvette. Cells were then transferred to a Petri dish containing 10 mL CHO medium and cultured at 37° C. under 5% $CO_2$ as previously described. On Days 3 post-transfection, cells were washed twice in phosphate-buffered saline (PBS), trypsinized, resuspended in 5 mL and percentage of GFP negative cells (200 µl at $2\times10^5$ cells/mL) was monitored by flow cytometry (Guava EasyCyte, Guava Technologies). The predicted score of each TALE-nuclease of the collection is calculated by summing all individual scores given in Table 8.

Example 6: Effect of Mismatches Number on TALE-Nuclease Activity

In this example, a collection of 104 TALE-nucleases is assayed for activity on their wild-type targets (51) according to the code A:NI, C:HD, G:NN and T:NG and targets (102) containing mismatches in RVD/base pair association according to the same code. Mismatches (between 0 and 9) are distributed in the two half TALE-nuclease binding sites and mismatches were not allowed in position 0.
RVD Array Synthesis and Yeast Activity Assay Both RVD arrays of the TALE-nuclease pair, targeting the desired sequences were synthesized using a solid support method composed of consecutive restriction/ligation/washing steps as shown in FIG. 1. In brief the first block (coding for a di-RVD) was immobilized on a solid support through biotin/streptavidin interaction, the second bloc (tri-RVD) is then ligated to the first and after SfaNI digestion a third bloc (tri-RVD) is coupled. The process is repeated using tri- or di-RVD blocs upon obtaining of the desired RVD array. The products are cloned in a classical pAPG10 cloning plasmid for amplification in *E. coli* and sequencing. The RVD array were then subcloned, as previously described, in yeast expression plasmids. Activity of these TALE-nuclease was monitored on their respective WT and mismatches containing targets using the yeast activity assay previously described. HTA and HTB correspond to the two half TALE-nuclease (binding sequence) of the TALE-nuclease hit, T is the wt target and TM the mutated one. For analysis only TALE-nucleases having an activity on their respective wt targets above 0.6 thresholds were taken in account.
Summary of Results The yeast assay used in this study is based on homologous recombination (HR) and especially the single strand annealing pathway (SSA) used after the creation of a double strand break by the TALE-nuclease nuclease in the target sequence localized between two repeated sequences. To minimize the bias of sequence dependence, to amplify potential effects and to simplify further analysis, we chose to perform activity screens and measurements in a homodimer TALE-nuclease format.

To perform a large scale study of the relation between the specificity and the activity of individual or multiple DNA binding modules in a TALE-nuclease context, we created collections containing either the 16 possible doublet or the 64 possible triplet RVDs (containing NI, HD, NN and NG) at various positions of the array. The collections of the corresponding DNA targets were prepared to allow nuclease activity measurements, in our yeast assay, of the possible 256 or 4096 combinations.

Collected data pointed out that, in position 1, the presence of the NI/A and HD/C pairs are unfavored and that, in position 2, the presence of the NI/A pair also has a deleterious effect.

Collected data also showed that, increasing TALE-nuclease length reduces this effect. By sliding the triplet collection along the TALE-nuclease RVDs and the target DNA from position 1/2/3 to position 3/4/5 and 5/6/7, no other such deleterious effect of base pair and RVD association was observed. We also present alternative triplets to efficiently target sequences containing AAN or CAN in positions 1/2/3. All TALE-nuclease/target triplets pairs, except the one containing AA and CA, have a very similar level of activity, indicating no or weak context dependence.

Using the entire set of data we computed matrices that describe the relative activity, depending of its position in the array (one to seven), of each RVDs on the four possible targets relative to the HD:C, NG:T NI:A and NN:G code. Interestingly these matrices only slightly differ from each other indicating a conserved pattern of activity/specificity/flexibility for each RVD along the TALE-nuclease array, ranging from position one to seven. We thus computed a global matrix, representing the mean specificity of each of the RVDs.

As the yeast assay represents a model for engineering TALE-nucleases, we have tested the robustness, and transportability of our findings, especially the global activity/specificity matrix in mammalian cells. We thus performed a large scale activity analysis, in our mammalian endogenous GFP reporter gene system, of 50 TALE-nuclease pairs, containing, in one monomer, various mismatches in position 1, 2 and/or 3 compared to the integrated target. In this system, decrease of the GFP signal due to NHEJ-mediated repair of TALE-nuclease induced double strand break is monitored three days post-transfection. We then predict and ranked the activity of TALE-nuclease compared to the one fitting perfectly to the target according to the HD:C, NG:T NI:A and NN:G code.

Example 7

A collection of 110 (including the 50 from example 5) TALE arrays were synthesized using a solid support as described in the previous examples (SEQ ID NO: 95 to 204). These TALE arrays were different in their RVD composition in specific windows encompassing position 1/2/3, 8/9, 10/11, 12/13/14 and 14/15. The RVD arrays were then individually subcloned, as previously described, into a mammalian expression plasmid pCLS8429 (SEQ ID NO: 81).

The RVD array of the second TALE of the pair was identical for all 110 TALE-nuclease (SEQ ID NO: 82) and was subcloned as previously described, into a mammalian expression plasmid pCLS8429 (SEQ ID NO: 81).

Activity of these 110 TALE-nuclease was monitored as described in example 5. Activities were normalized to the TALE-nuclease matching the target recognition sequence (SEQ ID NO: 85) using a NI:A, HD:C, NN: G and NG:T association. Analysis of the variation in activity in function of the studied windows and of the number of mismatches relative to the NI: A, HD:C, NN: G and NG:T association are presented in FIG. 11.

TABLE 1A

List of all tri-RVD members of any collection showing activity on specific pseudo-palindromic sequences targets

| target | mutant | | target | mutant | | target | mutant | | target | mutant | |
|---|---|---|---|---|---|---|---|---|---|---|---|
| AAA | HD-NI-NI | + | AAC | NI-HD-NI | + | AAG | NI-NI-HD | + | AAT | NI-NI-NN | + |
| AAA | HD-NI-NG | + | AAC | NI-NN-NI | + | AAG | NI-NG-NG | + | AAT | HD-NI-NN | + |
| AAA | HD-HD-NI | + | AAC | NI-NG-NI | + | AAG | NN-NI-NG | + | AAT | NN-NI-HD | + |
| AAA | HD-HD-NN | + | AAC | NI-NG-NN | + | AAG | HD-NG-NI | + | AAT | NN-NI-NN | + |
| AAA | HD-HD-NG | + | AAC | HD-HD-NI | + | AAG | HD-NG-NG | + | AAT | NN-HD-HD | + |
| AAA | NG-NG-HD | + | AAC | HD-HD-NN | + | AAG | NN-NI-NI | + | AAT | NN-NG-HD | + |
| AAA | NG-NG-NN | + | AAC | HD-HD-NG | + | AAG | NN-NI-HD | + | AAT | NN-NG-NN | + |
| AAA | NI-NI-HD | ++ | AAC | HD-NN-NI | + | AAG | NN-HD-HD | + | AAT | HD-NI-NG | ++ |
| AAA | NI-NI-NG | ++ | AAC | HD-NG-NN | + | AAG | NN-NG-HD | + | AAT | HD-HD-NG | ++ |
| AAA | NI-HD-HD | ++ | AAC | NN-NI-NI | + | AAG | NG-HD-HD | + | AAT | NI-NI-NG | +++ |
| AAA | NI-NG-NN | ++ | AAC | NN-NN-NI | + | AAG | NG-HD-NG | + | AAT | NI-HD-NG | +++ |
| AAA | NI-NG-NG | ++ | AAC | NG-NI-NG | + | AAG | NG-NG-NI | + | AAT | NI-NN-NG | +++ |
| AAA | HD-NI-NN | ++ | AAC | NG-HD-NI | + | AAG | NI-NI-NG | ++ | AAT | NI-NG-NG | +++ |
| AAA | HD-NN-HD | ++ | AAC | NG-NG-NG | + | AAG | NI-HD-NG | ++ | AAT | HD-NN-NG | +++ |
| AAA | HD-NN-NG | ++ | AAC | NI-NI-NN | ++ | AAG | NI-NN-NI | ++ | AAT | HD-NG-NG | +++ |
| AAA | HD-NG-NN | ++ | AAC | NI-NI-NG | ++ | AAG | NI-NN-NG | ++ | AAT | NN-NI-NG | +++ |
| AAA | HD-NG-NG | ++ | AAC | NI-HD-NN | ++ | AAG | NI-NG-NI | ++ | AAT | NN-HD-NG | +++ |
| AAA | NN-NI-NG | ++ | AAC | NI-NN-NN | ++ | AAG | HD-HD-NN | ++ | AAT | NN-NN-NG | +++ |
| AAA | NN-HD-HD | ++ | AAC | NI-NG-NG | ++ | AAG | HD-NN-NI | ++ | AAT | NN-NG-NG | +++ |
| AAA | NN-NG-NN | ++ | AAC | HD-NI-HD | ++ | AAG | HD-NN-NG | ++ | AAT | NG-NI-NG | +++ |
| AAA | NN-NG-NG | ++ | AAC | HD-HD-HD | ++ | AAG | NN-NI-NG | ++ | AAT | NG-HD-NG | +++ |
| AAA | NG-NI-NI | ++ | AAC | HD-NN-NN | ++ | AAG | NN-HD-NI | ++ | AAT | NG-NN-NG | +++ |
| AAA | NG-NI-HD | ++ | AAC | HD-NN-NG | ++ | AAG | NN-HD-NG | ++ | AAT | NG-NG-NG | +++ |
| AAA | NG-HD-HD | ++ | AAC | HD-NG-NG | ++ | AAG | NN-NN-NI | ++ | | | |
| AAA | NG-HD-NN | ++ | AAC | NN-NI-NN | ++ | AAG | NN-NN-NG | ++ | | | |
| AAA | NI-NI-NI | +++ | AAC | NN-NI-NG | ++ | AAG | NN-NG-NI | ++ | | | |
| AAA | NI-NI-NN | +++ | AAC | NN-HD-NI | ++ | AAG | NN-NG-NG | ++ | | | |
| AAA | NI-HD-NI | +++ | AAC | NN-HD-NN | ++ | AAG | NG-HD-NI | ++ | | | |
| AAA | NI-HD-NN | +++ | AAC | NN-NN-NN | ++ | AAG | NG-NN-NI | ++ | | | |
| AAA | NI-HD-NG | +++ | AAC | NN-NN-NG | ++ | AAG | NG-NN-NG | ++ | | | |
| AAA | NI-NN-NI | +++ | AAC | NN-NG-NI | ++ | AAG | NG-NG-NN | ++ | | | |
| AAA | NI-NN-HD | +++ | AAC | NN-NG-NN | ++ | AAG | NI-NI-NN | +++ | | | |
| AAA | NI-NN-NN | +++ | AAC | NN-NG-NG | ++ | AAG | NI-HD-NN | +++ | | | |
| AAA | NI-NN-NG | +++ | AAC | NG-NI-NN | ++ | AAG | NI-NN-NN | +++ | | | |

TABLE 1A-continued

List of all tri-RVD members of any collection showing activity on specific pseudo-palindromic sequences targets

| target | mutant | | target | mutant | | target | mutant | | target | mutant | |
|---|---|---|---|---|---|---|---|---|---|---|---|
| AAA | NI-NG-NI | +++ | AAC | NG-HD-NN | ++ | AAG | NI-NG-NN | +++ | | | |
| AAA | NI-NG-HD | +++ | AAC | NG-HD-NG | ++ | AAG | HD-NI-NN | +++ | | | |
| AAA | HD-NN-NI | +++ | AAC | NG-NN-NN | ++ | AAG | HD-NN-NN | +++ | | | |
| AAA | HD-NN-NN | +++ | AAC | NG-NN-NG | ++ | AAG | HD-NG-NN | +++ | | | |
| AAA | HD-NG-NI | +++ | AAC | NI-NI-HD | +++ | AAG | NN-NI-NN | +++ | | | |
| AAA | HD-NG-HD | +++ | AAC | NI-HD-HD | +++ | AAG | NN-HD-NN | +++ | | | |
| AAA | NN-NI-NI | +++ | AAC | NI-HD-NG | +++ | AAG | NN-NN-NN | +++ | | | |
| AAA | NN-NI-HD | +++ | AAC | NI-NN-HD | +++ | AAG | NN-NG-NN | +++ | | | |
| AAA | NN-NI-NN | +++ | AAC | NI-NN-NG | +++ | AAG | NG-NI-NN | +++ | | | |
| AAA | NN-HD-NI | +++ | AAC | NI-NG-HD | +++ | AAG | NG-HD-NNE | +++ | | | |
| AAA | NN-HD-NN | +++ | AAC | HD-NN-HD | +++ | AAG | NG-NN-NN | +++ | | | |
| AAA | NN-HD-NG | +++ | AAC | HD-NG-HD | +++ | | | | | | |
| AAA | NN-NN-NI | +++ | AAC | NN-NI-HD | +++ | | | | | | |
| AAA | NN-NN-HD | +++ | AAC | NN-HD-HD | +++ | | | | | | |
| AAA | NN-NN-NN | +++ | AAC | NN-HD-NG | +++ | | | | | | |
| AAA | NN-NN-NG | +++ | AAC | NN-NN-HD | +++ | | | | | | |
| AAA | NN-NG-NI | +++ | AAC | NN-NG-HD | +++ | | | | | | |
| AAA | NN-NG-HD | +++ | AAC | NG-NI-HD | +++ | | | | | | |
| AAA | NG-NI-NN | +++ | AAC | NG-HD-HD | +++ | | | | | | |
| AAA | NG-NI-NG | +++ | AAC | NG-NN-HD | +++ | | | | | | |
| AAA | NG-HD-NI | +++ | AAC | NG-NG-HD | +++ | | | | | | |
| AAA | NG-HD-NG | +++ | | | | | | | | | |
| AAA | NG-NN-NI | +++ | | | | | | | | | |
| AAA | NG-NN-HD | +++ | | | | | | | | | |
| AAA | NG-NN-NN | +++ | | | | | | | | | |
| AAA | NG-NN-NG | +++ | | | | | | | | | |
| AAA | NG-NG-NI | +++ | | | | | | | | | |
| AAA | NG-NG-NG | +++ | | | | | | | | | |

TABLE 1B

List of all tri-RVD members of any collection showing activity on specific pseudo-palindromic sequences targets

| target | mutant | | target | mutant | | target | mutant | | target | mutant | |
|---|---|---|---|---|---|---|---|---|---|---|---|
| ACA | NI-NG-NG | + | ACC | NI-NI-HD | + | ACG | NI-HD-HD | + | ACT | NI-NI-NG | + |
| ACA | HD-NI-NI | + | ACC | NI-NG-NG | + | ACG | NI-NN-NN | + | ACT | NI-NN-NG | + |
| ACA | HD-HD-HD | + | ACC | HD-NI-HD | + | ACG | HD-HD-NG | + | ACT | HD-NI-NG | + |
| ACA | HD-HD-NG | + | ACC | HD-NG-NG | + | ACG | HD-NN-NG | + | ACT | HD-HD-HD | + |
| ACA | HD-NN-HD | + | ACC | NN-NI-HD | + | ACG | HD-NN-NN | + | ACT | HD-HD-NN | + |
| ACA | HD-NG-NN | + | ACC | NN-NI-NG | + | ACG | NN-NI-NN | + | ACT | HD-NN-NG | + |
| ACA | HD-NG-NG | + | ACC | NN-NG-NI | + | ACG | NN-HD-HD | + | ACT | HD-NG-NG | + |
| ACA | NN-NI-NI | + | ACC | NG-NI-HD | + | ACG | NN-NN-NN | + | ACT | NN-HD-NI | + |
| ACA | NN-NI-NN | + | ACC | NG-NN-NG | + | ACG | NN-NN-NG | + | ACT | NN-HD-HD | + |
| ACA | NN-NI-NG | + | ACC | NG-NG-NG | + | ACG | NG-NI-NN | + | ACT | NN-NN-NG | + |
| ACA | NN-NN-NI | + | ACC | NI-NN-HD | ++ | ACG | NG-NN-NN | + | ACT | NG-NI-NG | + |
| ACA | NN-NN-HD | + | ACC | HD-HD-NN | ++ | ACG | NG-NG-NN | + | ACT | NG-HD-NN | + |
| ACA | NN-NN-NN | + | ACC | HD-HD-NG | ++ | ACG | NI-NI-NN | ++ | ACT | NG-NN-NG | + |
| ACA | NN-NN-NG | ++ | ACC | HD-NN-HD | ++ | ACG | NI-NG-NN | ++ | ACT | NI-HD-HD | ++ |
| ACA | NN-NG-HD | + | ACC | NN-NN-HD | ++ | ACG | HD-HD-NI | ++ | ACT | NI-HD-NN | ++ |
| ACA | NN-NG-NN | + | ACC | NN-NG-NG | ++ | ACG | NN-HD-NG | ++ | ACT | NI-NG-NG | ++ |
| ACA | NG-NN-NG | + | ACC | NG-HD-NN | ++ | ACG | NN-NG-NN | ++ | ACT | NN-NI-NG | ++ |
| ACA | NG-HD-HD | + | ACC | NG-NN-HD | ++ | ACG | NG-HD-NG | ++ | ACT | NN-HD-NN | ++ |
| ACA | NG-NG-NN | + | ACC | NG-NG-HD | ++ | ACG | NG-HD-NG | ++ | ACT | NN-NG-NG | ++ |
| ACA | NG-NG-NG | + | ACC | NI-HD-NI | +++ | ACG | NI-HD-NI | +++ | ACT | NG-HD-HD | ++ |
| ACA | NI-NI-NI | ++ | ACC | NI-HD-HD | +++ | ACG | NI-HD-NN | +++ | ACT | NG-NG-NG | ++ |
| ACA | NI-NN-NG | ++ | ACC | NI-HD-NN | +++ | ACG | NI-HD-NG | +++ | ACT | NI-HD-NG | +++ |
| ACA | NI-NG-NI | ++ | ACC | NI-HD-NG | +++ | ACG | HD-HD-NN | +++ | ACT | HD-HD-NG | +++ |
| ACA | NI-NG-HD | ++ | ACC | NI-NG-HD | +++ | ACG | NN-HD-NI | +++ | ACT | NN-HD-NG | +++ |
| ACA | NI-NG-NN | ++ | ACC | HD-HD-NI | +++ | ACG | NN-HD-NN | +++ | ACT | NG-HD-NG | +++ |
| ACA | HD-HD-NN | ++ | ACC | HD-HD-HD | +++ | ACG | NG-HD-NI | +++ | | | |
| ACA | HD-NN-NG | ++ | ACC | HD-NG-HD | +++ | ACG | NG-HD-NN | +++ | | | |
| ACA | HD-NG-NI | ++ | ACC | NN-HD-NI | +++ | | | | | | |
| ACA | NN-NG-NI | ++ | ACC | NN-HD-HD | +++ | | | | | | |
| ACA | NN-NG-NG | ++ | ACC | NN-HD-NN | +++ | | | | | | |
| ACA | NG-HD-NG | ++ | ACC | NN-HD-NG | +++ | | | | | | |
| ACA | NG-NN-NI | ++ | ACC | NN-NG-HD | +++ | | | | | | |
| ACA | NG-NG-NI | ++ | ACC | NG-HD-NI | +++ | | | | | | |
| ACA | NI-HD-NI | +++ | ACC | NG-HD-HD | +++ | | | | | | |
| ACA | NI-HD-HD | +++ | ACC | NG-HD-NG | +++ | | | | | | |

TABLE 1B-continued

List of all tri-RVD members of any collection showing activity on specific pseudo-palindromic sequences targets

| target | mutant | target | mutant | target | mutant | target | mutant |
|---|---|---|---|---|---|---|---|
| ACA | NI-HD-NN +++ | | | | | | |
| ACA | NI-HD-NG +++ | | | | | | |
| ACA | HD-HD-NI +++ | | | | | | |
| ACA | NN-HD-NI +++ | | | | | | |
| ACA | NN-HD-HD +++ | | | | | | |
| ACA | NN-HD-NN +++ | | | | | | |
| ACA | NN-HD-NG +++ | | | | | | |
| ACA | NG-HD-NI +++ | | | | | | |
| ACA | NG-HD-HD +++ | | | | | | |
| ACA | NG-HD-NN +++ | | | | | | |

TABLE 1C

List of all tri-RVD members of any collection showing activity on specific pseudo-palindromic sequences targets

| target | mutant | target | mutant | target | mutant | target | mutant |
|---|---|---|---|---|---|---|---|
| AGA | NI-NI-NI + | AGC | NI-HD-HD + | AGG | NI-NI-NN + | AGT | NI-NI-NN + |
| AGA | NI-NI-NN + | AGC | NI-NG-NN + | AGG | NI-HD-NN + | AGT | NI-NI-NG + |
| AGA | NI-NI-NG + | AGC | NI-NG-NG + | AGG | NI-NG-NI + | AGT | NI-HD-NG + |
| AGA | NI-HD-NN + | AGC | HD-NI-HD + | AGG | NI-NG-NG + | AGT | NI-NN-NI + |
| AGA | HD-NI-NN + | AGC | HD-HD-HD + | AGG | HD-NI-NN + | AGT | NI-NN-HD + |
| AGA | HD-NI-NG + | AGC | NN-NI-NI + | AGG | HD-NI-NG + | AGT | NI-NG-NN + |
| AGA | HD-HD-NN + | AGC | NN-NI-HD + | AGG | HD-NN-HD + | AGT | HD-NI-NN + |
| AGA | HD-NG-HD + | AGC | NN-HD-NI + | AGG | HD-NG-NG + | AGT | HD-HD-NG + |
| AGA | NN-NI-HD + | AGC | NN-HD-NG + | AGG | NN-NI-NN + | AGT | HD-NN-NI + |
| AGA | NN-HD-HD + | AGC | NN-NG-NN + | AGG | NN-NI-NG + | AGT | NN-NN-HD + |
| AGA | NN-HD-NN + | AGC | NG-NI-HD + | AGG | NN-HD-NN + | AGT | HD-NN-NN + |
| AGA | NN-HD-NG + | AGC | NG-HD-HD + | AGG | NG-NI-NN + | AGT | NN-NI-HD + |
| AGA | NG-NI-NI + | AGC | NG-NN-NI + | AGG | NG-NG-NN + | AGT | NN-NN-NI + |
| AGA | NG-NI-HD + | AGC | NG-NG-NI + | AGG | NI-NN-HD ++ | AGT | NN-NG-NI + |
| AGA | NG-NI-NG + | AGC | NG-NG-NG + | AGG | NI-NN-NG ++ | AGT | NN-NG-HD + |
| AGA | NG-HD-NI + | AGC | NI-NN-NN ++ | AGG | NI-NG-NN ++ | AGT | NN-NG-NN + |
| AGA | NG-NG-HD + | AGC | NI-NG-NI ++ | AGG | HD-NN-NG ++ | AGT | NG-NI-NN + |
| AGA | NI-NG-NI ++ | AGC | NI-NG-HD ++ | AGG | HD-NG-NN ++ | AGT | NG-HD-NG + |
| AGA | NI-NG-NN ++ | AGC | HD-NN-NN ++ | AGG | NN-NI-NI ++ | AGT | NG-NN-NN + |
| AGA | NI-NG-NG ++ | AGC | HD-NN-NG ++ | AGG | NN-NN-NG ++ | AGT | NI-NN-NN ++ |
| AGA | HD-NN-HD ++ | AGC | HD-NG-HD ++ | AGG | NN-NG-NI ++ | AGT | NI-NG-NG ++ |
| AGA | HD-NG-NI ++ | AGC | HD-NG-NG ++ | AGG | NN-NG-NG ++ | AGT | HD-NI-NG ++ |
| AGA | HD-NG-NN ++ | AGC | NN-NI-NG ++ | AGG | NG-NN-NI ++ | AGT | HD-NG-NG ++ |
| AGA | NN-NI-NI ++ | AGC | NN-HD-HD ++ | AGG | NG-NN-NG ++ | AGT | NN-NI-NN ++ |
| AGA | NN-NI-NN ++ | AGC | NN-NN-NI ++ | AGG | NG-NG-NG ++ | AGT | NN-HD-NG ++ |
| AGA | NN-NI-NG ++ | AGC | NN-NN-NN ++ | AGG | NI-NN-NN +++ | AGT | NN-NN-NN ++ |
| AGA | NN-HD-NI ++ | AGC | NN-NG-NI ++ | AGG | HD-NN-NI +++ | AGT | NG-NI-NG ++ |
| AGA | NN-NG-NI ++ | AGC | NN-NG-HD ++ | AGG | HD-NN-NN +++ | AGT | NG-NG-NG ++ |
| AGA | NN-NG-HD ++ | AGC | NN-NG-NG ++ | AGG | NN-NN-NI +++ | AGT | NI-NN-NG +++ |
| AGA | NN-NG-NN ++ | AGC | NG-NN-NN ++ | AGG | NN-NN-NN +++ | AGT | HD-NN-NG +++ |
| AGA | NN-NG-NG ++ | AGC | NG-NN-NG ++ | AGG | NG-NN-NN +++ | AGT | NN-NI-NG +++ |
| AGA | NG-NI-NN ++ | AGC | NG-NG-HD ++ | | | AGT | NN-NN-NG +++ |
| AGA | NG-NN-HD ++ | AGC | NI-NN-NI +++ | | | AGT | NN-NG-NG +++ |
| AGA | NG-NG-NN ++ | AGC | NI-NN-HD +++ | | | AGT | NG-NN-NG +++ |
| AGA | NG-NG-NG ++ | AGC | NI-NN-NG +++ | | | | |
| AGA | NI-NN-NI +++ | AGC | HD-NN-NI +++ | | | | |
| AGA | NI-NN-HD +++ | AGC | HD-NN-HD +++ | | | | |
| AGA | NI-NN-NN +++ | AGC | NN-NN-HD +++ | | | | |
| AGA | NI-NN-NG +++ | AGC | NN-NN-NG +++ | | | | |
| AGA | HD-NN-NI +++ | AGC | NG-NN-HD +++ | | | | |
| AGA | HD-NN-NN +++ | | | | | | |
| AGA | HD-NN-NG +++ | | | | | | |
| AGA | HD-NG-NG +++ | | | | | | |
| AGA | NN-NN-NI +++ | | | | | | |
| AGA | NN-NN-HD +++ | | | | | | |
| AGA | NN-NN-NN +++ | | | | | | |
| AGA | NN-NN-NG +++ | | | | | | |
| AGA | NG-NN-NI +++ | | | | | | |
| AGA | NG-NN-NN +++ | | | | | | |
| AGA | NG-NN-NG +++ | | | | | | |
| AGA | NG-NG-NI +++ | | | | | | |

TABLE 1D

List of all tri-RVD members of any collection showing activity on specific pseudo-palindromic sequences targets

| target | mutant | | target | mutant | | target | mutant | | target | mutant | |
|---|---|---|---|---|---|---|---|---|---|---|---|
| ATA | NI-NI-NI | + | ATC | NI-HD-HD | + | ATG | NI-NI-HD | + | ATT | NI-NN-NG | + |
| ATA | NI-NI-HD | + | ATC | HD-HD-HD | + | ATG | NI-HD-NG | + | ATT | NI-NG-NI | + |
| ATA | NI-HD-NN | + | ATC | HD-NN-HD | + | ATG | HD-HD-NN | + | ATT | NI-NG-HD | + |
| ATA | NI-NN-NI | + | ATC | HD-NG-NI | + | ATG | HD-NG-HD | + | ATT | HD-HD-NG | + |
| ATA | NI-NN-HD | + | ATC | HD-NG-NN | + | ATG | NN-HD-NN | + | ATT | HD-HD-NN | + |
| ATA | NI-NN-NN | + | ATC | NN-NI-NG | + | ATG | NN-NN-NN | + | ATT | HD-NG-HD | + |
| ATA | HD-NI-HD | + | ATC | NN-HD-NI | + | ATG | NI-HD-NI | ++ | ATT | NN-NN-NG | + |
| ATA | NN-NI-NG | + | ATC | NN-HD-HD | + | ATG | NI-HD-NN | ++ | ATT | NN-NG-NI | + |
| ATA | NN-HD-NN | + | ATC | NN-NN-HD | + | ATG | HD-NN-NN | ++ | ATT | NN-NG-HD | + |
| ATA | NN-NN-NI | + | ATC | NN-NN-NG | + | ATG | NI-NG-HD | ++ | ATT | NN-NG-NN | + |
| ATA | NN-NN-HD | + | ATC | NG-NN-HD | + | ATG | HD-NG-NG | ++ | ATT | NG-HD-NG | + |
| ATA | NG-NN-NG | + | ATC | NG-NG-NI | + | ATG | NN-NG-HD | ++ | ATT | NG-NN-NG | + |
| ATA | NI-HD-NG | ++ | ATC | NG-NG-NN | + | ATG | NI-HD-NN | ++ | ATT | NG-NG-HD | + |
| ATA | NI-NN-NG | ++ | ATC | NI-HD-NI | ++ | ATG | NG-NG-NI | ++ | ATT | NI-NI-NG | ++ |
| ATA | HD-HD-NI | ++ | ATC | NI-HD-NG | ++ | ATG | NI-NG-NI | +++ | ATT | NI-HD-NI | ++ |
| ATA | NN-HD-NI | ++ | ATC | NI-NN-HD | ++ | ATG | NI-NG-NN | +++ | ATT | NI-HD-NG | ++ |
| ATA | NN-NN-NG | ++ | ATC | NI-NG-NI | ++ | ATG | NI-NG-NG | +++ | ATT | NI-NG-NN | ++ |
| ATA | NG-HD-NI | ++ | ATC | NN-HD-NG | ++ | ATG | HD-NG-NN | +++ | ATT | NN-NI-NG | ++ |
| ATA | NI-HD-NI | +++ | ATC | NN-NG-NN | ++ | ATG | HD-NG-NN | +++ | ATT | NN-HD-NG | ++ |
| ATA | NI-NG-NI | +++ | ATC | NG-HD-HD | ++ | ATG | NN-NG-NI | +++ | ATT | NI-NG-NG | +++ |
| ATA | NI-NG-HD | +++ | ATC | NG-NG-NG | ++ | ATG | NN-NG-NN | +++ | ATT | HD-NG-NG | +++ |
| ATA | NI-NG-NN | +++ | ATC | NI-NG-HD | +++ | ATG | NN-NG-NG | +++ | ATT | NN-NG-NG | +++ |
| ATA | NI-NG-NG | +++ | ATC | NI-NG-NN | +++ | ATG | NG-NG-NN | +++ | ATT | NG-NG-NG | +++ |
| ATA | HD-NG-NI | +++ | ATC | NI-NG-NG | +++ | ATG | NG-NG-NG | +++ | | | |
| ATA | HD-NG-HD | +++ | ATC | HD-NG-HD | +++ | | | | | | |
| ATA | HD-NG-NN | +++ | ATC | HD-NG-NG | +++ | | | | | | |
| ATA | HD-NG-NG | +++ | ATC | NN-NG-NI | +++ | | | | | | |
| ATA | NN-NG-NI | +++ | ATC | NN-NG-HD | +++ | | | | | | |
| ATA | NN-NG-HD | +++ | ATC | NN-NG-NG | +++ | | | | | | |
| ATA | NN-NG-NN | +++ | ATC | NG-NG-HD | +++ | | | | | | |
| ATA | NN-NG-NG | +++ | | | | | | | | | |
| ATA | NG-NG-NI | +++ | | | | | | | | | |
| ATA | NG-NG-HD | +++ | | | | | | | | | |
| ATA | NG-NG-NN | +++ | | | | | | | | | |
| ATA | NG-NG-NG | +++ | | | | | | | | | |

TABLE 1E

List of all tri-RVD members of any collection showing activity on specific pseudo-palindromic sequences targets

| target | mutant | | target | mutant | | target | mutant | | target | mutant | |
|---|---|---|---|---|---|---|---|---|---|---|---|
| CAA | NI-HD-HD | + | CAC | NI-NI-HD | + | CAG | NI-HD-NN | + | CAT | NI-HD-NI | + |
| CAA | NI-NN-NI | + | CAC | NI-HD-HD | + | CAG | NI-NN-NN | + | CAT | NI-NG-NI | + |
| CAA | NI-NN-NN | + | CAC | NI-NG-NI | + | CAG | NI-NG-NI | + | CAT | NI-NG-NG | + |
| CAA | NI-NG-NI | + | CAC | NI-NG-NN | + | CAG | NI-NG-NN | + | CAT | HD-HD-NN | + |
| CAA | HD-NI-NG | + | CAC | HD-NG-NI | + | CAG | HD-NI-NG | + | CAT | NN-NG-HD | + |
| CAA | HD-HD-NG | + | CAC | NN-NI-HD | + | CAG | HD-HD-NI | + | CAT | HD-NN-HD | + |
| CAA | HD-NG-HD | + | CAC | HD-HD-NG | + | CAG | HD-NG-NG | + | CAT | NI-NI-NG | ++ |
| CAA | NN-NI-NI | + | CAC | NN-NN-HD | + | CAG | HD-HD-NG | + | CAT | NI-HD-NG | ++ |
| CAA | NN-NI-NN | + | CAC | NN-NN-NG | + | CAG | HD-NG-NG | + | CAT | NI-NN-NG | ++ |
| CAA | NN-HD-NN | + | CAC | NN-NI-NG | + | CAG | HD-NG-NG | + | CAT | HD-NI-HD | ++ |
| CAA | NN-HD-NG | + | CAC | NG-HD-NI | + | CAG | NN-NI-NN | + | CAT | HD-NI-NN | ++ |
| CAA | NN-NN-NI | + | CAC | NG-NG-NG | + | CAG | NN-NN-NN | + | CAT | NN-NI-NG | ++ |
| CAA | NN-NN-NN | + | CAC | NI-NN-HD | ++ | CAG | NN-NG-NN | + | CAT | NN-HD-NG | ++ |
| CAA | NN-NG-HD | + | CAC | NI-NG-HD | ++ | CAG | NG-NN-NG | + | CAT | NN-NN-NG | ++ |
| CAA | NN-NG-NG | + | CAC | HD-NI-NN | ++ | CAG | NG-NN-NG | + | CAT | NG-HD-NG | ++ |
| CAA | NG-NI-HD | + | CAC | HD-NI-NG | ++ | CAG | NG-NG-NN | + | CAT | NG-NG-NG | ++ |
| CAA | NG-NI-NG | + | CAC | HD-HD-NI | ++ | CAG | NI-NI-NN | ++ | CAT | HD-NI-NG | +++ |
| CAA | NG-NG-HD | + | CAC | HD-HD-NN | ++ | CAG | HD-NN-NG | ++ | CAT | HD-HD-NG | +++ |
| CAA | NG-NG-NN | + | CAC | HD-HD-NG | ++ | CAG | HD-NG-NN | ++ | CAT | HD-NN-NG | +++ |
| CAA | NG-NG-NG | + | CAC | HD-NN-NI | ++ | CAG | NN-HD-NN | ++ | CAT | HD-NG-NG | +++ |
| CAA | HD-NI-NI | ++ | CAC | HD-NN-NN | ++ | CAG | NG-NN-NI | ++ | CAT | NG-NI-NG | +++ |
| CAA | HD-NI-NN | ++ | CAC | HD-NG-NN | ++ | CAG | HD-NI-NN | +++ | CAT | NG-NN-NG | +++ |
| CAA | HD-HD-NI | ++ | CAC | HD-NG-NG | ++ | CAG | HD-HD-NN | +++ | | | |
| CAA | HD-HD-NN | ++ | CAC | NN-HD-HD | ++ | CAG | HD-NN-NI | +++ | | | |
| CAA | HD-NN-HD | ++ | CAC | NN-NG-HD | ++ | CAG | HD-NN-NN | +++ | | | |
| CAA | HD-NN-NG | ++ | CAC | NG-HD-NN | ++ | CAG | NG-NI-NN | +++ | | | |

TABLE 1E-continued

List of all tri-RVD members of any collection showing activity on specific pseudo-palindromic sequences targets

| target | mutant | | target | mutant | | target | mutant | | target | mutant | |
|---|---|---|---|---|---|---|---|---|---|---|---|
| CAA | HD-NG-NI | ++ | CAC | NG-HD-NG | ++ | CAG | NG-HD-NN | +++ | | | |
| CAA | HD-NG-NN | ++ | CAC | NG-NN-NN | ++ | CAG | NG-NN-NN | +++ | | | |
| CAA | HD-NG-NG | ++ | CAC | HD-NI-NI | +++ | | | | | | |
| CAA | NN-NI-NG | ++ | CAC | HD-NI-HD | +++ | | | | | | |
| CAA | NN-HD-NI | ++ | CAC | HD-HD-HD | +++ | | | | | | |
| CAA | NN-NG-NI | ++ | CAC | HD-NN-HD | +++ | | | | | | |
| CAA | NG-NI-NI | ++ | CAC | HD-NG-HD | +++ | | | | | | |
| CAA | NG-NI-NN | ++ | CAC | NG-NI-HD | +++ | | | | | | |
| CAA | NG-HD-NI | ++ | CAC | NG-HD-HD | +++ | | | | | | |
| CAA | NG-HD-HD | ++ | CAC | NG-NN-HD | +++ | | | | | | |
| CAA | NG-HD-NN | ++ | CAC | NG-NN-NG | +++ | | | | | | |
| CAA | NG-HD-NG | ++ | CAC | NG-NG-HD | +++ | | | | | | |
| CAA | NG-NN-HD | ++ | | | | | | | | | |
| CAA | NG-NN-NG | ++ | | | | | | | | | |
| CAA | NG-NG-NI | ++ | | | | | | | | | |
| CAA | HD-NI-NI | +++ | | | | | | | | | |
| CAA | HD-NN-NI | +++ | | | | | | | | | |
| CAA | HD-NN-NN | +++ | | | | | | | | | |
| CAA | NG-NN-NI | +++ | | | | | | | | | |
| CAA | NG-NN-NN | +++ | | | | | | | | | |

TABLE 1F

List of all tri-RVD members of any collection showing activity on specific pseudo-palindromic sequences targets

| target | mutant | | target | mutant | | target | mutant | | target | mutant | |
|---|---|---|---|---|---|---|---|---|---|---|---|
| CCA | NI-HD-NN | + | CCC | HD-NI-NG | + | CCG | HD-NI-NI | + | CCT | NI-NG-NI | + |
| CCA | NI-NG-NI | + | CCC | HD-NG-NN | + | CCG | HD-HD-HD | + | CCT | NI-NG-NG | + |
| CCA | HD-NI-NN | + | CCC | HD-NG-NG | + | CCG | HD-NN-NN | + | CCT | HD-NI-NN | + |
| CCA | HD-NI-NG | + | CCC | NN-HD-NN | + | CCG | HD-NG-NI | + | CCT | HD-NN-HD | + |
| CCA | HD-NN-NI | + | CCC | NN-NN-HD | + | CCG | NN-HD-NI | + | CCT | HD-NN-NG | + |
| CCA | HD-NN-HD | + | CCC | NN-NG-HD | + | CCG | NN-HD-NG | + | CCT | HD-NG-HD | + |
| CCA | HD-NN-NN | + | CCC | NG-NG-NG | + | CCG | NG-NN-NN | + | CCT | NN-NI-NG | + |
| CCA | HD-NN-NG | + | CCC | NI-HD-HD | ++ | CCG | NG-NG-NN | + | CCT | NN-NG-NG | + |
| CCA | HD-NG-HD | + | CCC | NI-HD-NG | ++ | CCG | NI-HD-NN | ++ | CCT | NG-NI-NG | + |
| CCA | HD-NG-NN | + | CCC | NI-NG-HD | ++ | CCG | HD-NI-NN | ++ | CCT | NG-HD-NN | + |
| CCA | NN-HD-HD | + | CCC | HD-NI-NI | ++ | CCG | HD-HD-NG | ++ | CCT | NG-NN-NG | + |
| CCA | NN-HD-NG | + | CCC | HD-NG-NI | ++ | CCG | HD-NG-NN | ++ | CCT | NG-NG-NG | + |
| CCA | NN-NG-NI | + | CCC | NN-HD-NI | ++ | CCG | NG-HD-NI | ++ | CCT | NI-HD-NG | ++ |
| CCA | NG-NN-NI | + | CCC | NN-HD-NG | ++ | CCG | NG-HD-HD | ++ | CCT | HD-NI-HD | ++ |
| CCA | NG-NN-NG | + | CCC | NG-HD-NN | ++ | CCG | NG-HD-NG | ++ | CCT | HD-NI-NG | ++ |
| CCA | NG-NG-HD | + | CCC | NG-HD-NG | ++ | CCG | HD-HD-NI | +++ | CCT | HD-HD-NI | ++ |
| CCA | NG-NG-NN | + | CCC | NG-NN-HD | ++ | CCG | HD-HD-NN | +++ | CCT | HD-HD-NN | ++ |
| CCA | NI-HD-NI | ++ | CCC | NG-NG-HD | ++ | CCG | NN-HD-NN | +++ | CCT | NG-HD-HD | ++ |
| CCA | HD-NI-HD | ++ | CCC | HD-NI-HD | +++ | CCG | NG-HD-NN | +++ | CCT | HD-HD-HD | +++ |
| CCA | HD-HD-NG | ++ | CCC | HD-HD-NI | +++ | | | | CCT | HD-HD-NG | +++ |
| CCA | HD-NG-NI | ++ | CCC | HD-HD-HD | +++ | | | | CCT | HD-NG-NG | +++ |
| CCA | HD-NG-NG | ++ | CCC | HD-HD-NN | +++ | | | | CCT | NN-HD-NG | +++ |
| CCA | NN-HD-NN | ++ | CCC | HD-HD-NG | +++ | | | | CCT | NG-HD-NG | +++ |
| CCA | NG-HD-HD | ++ | CCC | HD-NN-HD | +++ | | | | | | |
| CCA | NG-HD-NG | ++ | CCC | HD-NG-HD | +++ | | | | | | |
| CCA | NG-NG-NI | ++ | CCC | NN-HD-HD | +++ | | | | | | |
| CCA | HD-NI-NI | +++ | CCC | NG-HD-NI | +++ | | | | | | |
| CCA | HD-HD-NI | +++ | CCC | NG-HD-HD | +++ | | | | | | |
| CCA | HD-HD-HD | +++ | | | | | | | | | |
| CCA | HD-HD-NN | +++ | | | | | | | | | |
| CCA | NN-HD-NI | +++ | | | | | | | | | |
| CCA | NG-HD-NI | +++ | | | | | | | | | |
| CCA | NG-HD-NN | +++ | | | | | | | | | |

TABLE 1G

List of all tri-RVD members of any collection showing activity on specific pseudo-palindromic sequences targets

| target | mutant | | target | mutant | | target | mutant | | target | mutant | |
|---|---|---|---|---|---|---|---|---|---|---|---|
| CGA | NI-NG-NI | + | CGC | NI-NN-NI | + | CGG | HD-NI-NI | + | CGT | NI-NG-NI | + |
| CGA | HD-NI-NN | + | CGC | NI-NG-HD | + | CGG | HD-NI-NN | + | CGT | NI-NG-NG | + |
| CGA | HD-NI-NG | + | CGC | HD-NI-NI | + | CGG | HD-HD-NN | + | CGT | HD-NI-NN | + |
| CGA | HD-HD-NI | + | CGC | HD-NG-NG | + | CGG | HD-NN-HD | + | CGT | HD-HD-NG | + |
| CGA | NN-NI-NI | + | CGC | NN-NN-NI | + | CGG | HD-NG-NI | + | CGT | NG-NI-NG | + |
| CGA | NN-NN-HD | + | CGC | NN-NG-NI | + | CGG | HD-NG-NG | + | CGT | NG-NG-NG | + |
| CGA | NN-NN-NG | + | CGC | NN-NG-NG | + | CGG | NN-NI-NI | + | CGT | NI-NN-NG | ++ |
| CGA | NN-NG-NG | + | CGC | NG-NN-NI | + | CGG | NN-NN-NI | + | CGT | HD-NI-HD | ++ |
| CGA | NG-HD-NN | + | CGC | NG-NN-NN | + | CGG | NN-NG-NN | + | CGT | HD-NI-NG | ++ |
| CGA | NG-NG-NN | + | CGC | NG-NG-NG | + | CGG | NG-NG-NN | + | CGT | HD-NN-NI | ++ |
| CGA | NI-NN-NI | ++ | CGC | NI-NN-HD | ++ | CGG | NI-NN-NN | ++ | CGT | HD-NN-HD | ++ |
| CGA | NI-NN-NN | ++ | CGC | HD-NI-HD | ++ | CGG | HD-NG-NN | ++ | CGT | HD-NN-NN | ++ |
| CGA | HD-NI-NI | ++ | CGC | HD-HD-HD | ++ | CGG | HD-NN-NI | ++ | CGT | NN-NI-NG | ++ |
| CGA | HD-NN-HD | ++ | CGC | NN-NN-HD | ++ | CGG | NG-NN-NI | ++ | CGT | NN-NN-NG | ++ |
| CGA | HD-NG-NI | ++ | CGC | NN-NG-HD | ++ | CGG | HD-NN-NI | +++ | CGT | NN-NG-NG | ++ |
| CGA | HD-NG-NN | ++ | CGC | NG-HD-HD | ++ | CGG | HD-NN-NN | +++ | CGT | HD-NN-NG | +++ |
| CGA | HD-NG-NG | ++ | CGC | NG-NN-NG | ++ | CGG | HD-NN-NG | +++ | CGT | HD-NG-NG | +++ |
| CGA | NN-NN-NN | ++ | CGC | NG-NG-HD | ++ | CGG | NG-NN-NN | +++ | CGT | NG-NN-NG | +++ |
| CGA | NN-NG-NI | ++ | CGC | HD-NN-NI | +++ | | | | | | |
| CGA | NG-NN-HD | ++ | CGC | HD-NN-HD | +++ | | | | | | |
| CGA | NG-NG-NI | ++ | CGC | HD-NN-NN | +++ | | | | | | |
| CGA | HD-NN-NI | +++ | CGC | HD-NN-NG | +++ | | | | | | |
| CGA | HD-NN-NN | +++ | CGC | HD-NG-HD | +++ | | | | | | |
| CGA | HD-NN-NG | +++ | CGC | NG-NN-HD | +++ | | | | | | |
| CGA | NN-NN-NI | +++ | | | | | | | | | |
| CGA | NG-NN-NI | +++ | | | | | | | | | |
| CGA | NG-NN-NN | +++ | | | | | | | | | |
| CGA | NG-NN-NG | +++ | | | | | | | | | |

TABLE 1H

List of all tri-RVD members of any collection showing activity on specific pseudo-palindromic sequences targets

| target | mutant | | target | mutant | | target | mutant | | target | mutant | |
|---|---|---|---|---|---|---|---|---|---|---|---|
| CTA | NI-NI-HD | + | CTC | NI-NG-NG | + | CTG | NI-HD-NN | + | CTT | NI-HD-NG | + |
| CTA | NI-HD-NI | + | CTC | HD-NI-NG | + | CTG | NI-NG-NI | + | CTT | HD-NI-NG | + |
| CTA | NI-NG-NN | + | CTC | HD-HD-NI | + | CTG | NN-NG-NI | + | CTT | HD-NN-NG | + |
| CTA | NI-NG-NG | + | CTC | NN-NG-NI | + | CTG | NN-NG-NG | + | CTT | HD-NG-HD | + |
| CTA | HD-HD-NN | + | CTC | NG-NG-NI | + | CTG | HD-HD-NI | ++ | CTT | NN-HD-NG | + |
| CTA | HD-NN-NN | + | CTC | HD-HD-HD | ++ | CTG | HD-HD-NN | ++ | CTT | NG-NN-NG | + |
| CTA | NN-NG-HD | + | CTC | HD-HD-NG | ++ | CTG | HD-NN-NI | ++ | CTT | NI-NG-NG | ++ |
| CTA | NN-NG-NN | + | CTC | HD-NN-HD | ++ | CTG | HD-NN-NN | ++ | CTT | HD-HD-NG | ++ |
| CTA | NI-NG-HD | ++ | CTC | HD-NG-NI | ++ | CTG | HD-NG-HD | ++ | CTT | NN-NG-NG | ++ |
| CTA | HD-NN-NI | ++ | CTC | HD-NG-NN | ++ | CTG | HD-NG-NG | ++ | CTT | HD-NG-NG | +++ |
| CTA | NN-NG-NI | ++ | CTC | NN-NG-NG | ++ | CTG | NN-NG-NN | ++ | CTT | NG-NG-NG | +++ |
| CTA | NN-NG-NG | ++ | CTC | NG-HD-HD | ++ | CTG | NG-HD-NN | ++ | | | |
| CTA | NG-HD-NI | ++ | CTC | NG-NG-NG | ++ | CTG | NG-NG-NI | ++ | | | |
| CTA | NG-NG-HD | ++ | CTC | NI-NG-HD | +++ | CTG | NG-NG-NG | ++ | | | |
| CTA | NI-NG-NI | +++ | CTC | HD-NG-HD | +++ | CTG | NI-NG-NN | +++ | | | |
| CTA | HD-NI-NI | +++ | CTC | HD-NG-NG | +++ | CTG | HD-NG-NI | +++ | | | |
| CTA | HD-HD-NI | +++ | CTC | NN-NG-HD | +++ | CTG | HD-NG-NN | +++ | | | |
| CTA | HD-NG-NI | +++ | CTC | NG-NG-HD | +++ | CTG | NG-NG-NN | +++ | | | |
| CTA | HD-NG-HD | +++ | | | | | | | | | |
| CTA | HD-NG-NN | +++ | | | | | | | | | |
| CTA | HD-NG-NG | +++ | | | | | | | | | |
| CTA | NG-NG-NI | +++ | | | | | | | | | |
| CTA | NG-NG-NN | +++ | | | | | | | | | |
| CTA | NG-NG-NG | +++ | | | | | | | | | |

TABLE 1I

List of all tri-RVD members of any collection showing activity on specific pseudo-palindromic sequences targets

| target | mutant | | target | mutant | | target | mutant | | target | mutant | |
|---|---|---|---|---|---|---|---|---|---|---|---|
| GAA | NI-NI-NI | + | GAC | NI-NI-HD | + | GAG | NI-HD-NN | + | GAT | NI-HD-NG | + |
| GAA | NI-NI-NN | + | GAC | NI-HD-HD | + | GAG | NI-NG-NN | + | GAT | NI-NG-NG | + |
| GAA | NI-HD-NN | + | GAC | NI-NG-NI | + | GAG | HD-NN-NN | + | GAT | HD-NI-NG | + |
| GAA | NI-NN-HD | + | GAC | NI-NG-NG | + | GAG | NN-NI-HD | + | GAT | HD-NN-NG | + |
| GAA | NI-NG-NN | + | GAC | HD-NI-HD | + | GAG | NN-HD-NI | + | GAT | HD-NG-NG | + |
| GAA | NI-NG-NG | + | GAC | HD-NN-HD | + | GAG | NN-HD-NG | + | GAT | NN-NN-HD | + |
| GAA | HD-NN-NI | + | GAC | HD-NG-HD | + | GAG | NN-NN-HD | + | GAT | NN-NN-NN | + |
| GAA | HD-NG-NI | + | GAC | NN-NG-NN | + | GAG | NN-NG-HD | + | GAT | NN-NG-HD | + |
| GAA | NN-HD-HD | + | GAC | NG-HD-NG | + | GAG | NG-HD-NN | + | GAT | NN-NG-NN | + |
| GAA | NG-NI-NI | + | GAC | NG-NN-NG | + | GAG | NG-NN-NG | + | GAT | NG-HD-NG | + |
| GAA | NG-NI-HD | + | GAC | NI-NN-HD | ++ | GAG | NG-NG-NN | + | GAT | NG-NG-NG | + |
| GAA | NG-NI-NG | + | GAC | NI-NG-HD | ++ | GAG | NI-NI-NN | ++ | GAT | NI-NI-NG | ++ |
| GAA | NG-HD-NI | + | GAC | NN-NI-NI | ++ | GAG | NI-NN-NN | ++ | GAT | NI-NN-NG | ++ |
| GAA | NG-HD-NN | + | GAC | NN-NI-NN | ++ | GAG | NN-NI-NI | ++ | GAT | NN-NI-HD | ++ |
| GAA | NG-HD-NG | + | GAC | NN-HD-NI | ++ | GAG | NN-NI-NG | ++ | GAT | NN-NI-NN | ++ |
| GAA | NG-NN-HD | + | GAC | NN-HD-NN | ++ | GAG | NN-NN-NI | ++ | GAT | NG-NI-NG | ++ |
| GAA | NG-NG-HD | + | GAC | NN-HD-NG | ++ | GAG | NN-NN-NG | ++ | GAT | NG-NN-NG | ++ |
| GAA | NG-NG-NN | + | GAC | NN-NN-NI | ++ | GAG | NN-NG-NI | ++ | GAT | NN-NI-NG | +++ |
| GAA | NG-NG-NG | + | GAC | NN-NN-NN | ++ | GAG | NN-NG-NG | ++ | GAT | NN-HD-NG | +++ |
| GAA | NI-NN-NI | ++ | GAC | NN-NN-NG | ++ | GAG | NG-NI-NN | ++ | GAT | NN-NN-NG | +++ |
| GAA | NI-NN-NN | ++ | GAC | NN-NG-NI | ++ | GAG | NN-NI-NN | +++ | GAT | NN-NG-NG | +++ |
| GAA | NI-NN-NG | ++ | GAC | NN-NG-NG | ++ | GAG | NN-HD-NN | +++ | | | |
| GAA | NI-NG-NI | ++ | GAC | NG-NI-HD | ++ | GAG | NN-NN-NN | +++ | | | |
| GAA | NN-NI-HD | ++ | GAC | NG-HD-HD | ++ | GAG | NN-NG-NN | +++ | | | |
| GAA | NN-HD-NG | ++ | GAC | NG-NN-HD | ++ | GAG | NG-NN-NN | +++ | | | |
| GAA | NN-NG-NN | ++ | GAC | NG-NG-HD | ++ | | | | | | |
| GAA | NN-NG-NG | ++ | GAC | NN-NI-HD | +++ | | | | | | |
| GAA | NG-NI-NN | ++ | GAC | NN-NI-NG | +++ | | | | | | |
| GAA | NG-NN-NI | ++ | GAC | NN-HD-HD | +++ | | | | | | |
| GAA | NG-NN-NN | ++ | GAC | NN-NN-HD | +++ | | | | | | |
| GAA | NG-NN-NG | ++ | GAC | NN-NG-HD | +++ | | | | | | |
| GAA | NG-NG-NI | ++ | | | | | | | | | |
| GAA | NN-NI-NI | +++ | | | | | | | | | |
| GAA | NN-NI-NN | +++ | | | | | | | | | |
| GAA | NN-NI-NG | +++ | | | | | | | | | |
| GAA | NN-HD-NI | +++ | | | | | | | | | |
| GAA | NN-HD-NN | +++ | | | | | | | | | |
| GAA | NN-NN-NI | +++ | | | | | | | | | |
| GAA | NN-NN-HD | +++ | | | | | | | | | |
| GAA | NN-NN-NN | +++ | | | | | | | | | |
| GAA | NN-NN-NG | +++ | | | | | | | | | |
| GAA | NN-NG-NI | +++ | | | | | | | | | |
| GAA | NN-NG-HD | +++ | | | | | | | | | |

TABLE 1J

List of all tri-RVD members of any collection showing activity on specific pseudo-palindromic sequences targets

| target | mutant | | target | mutant | | target | mutant | | target | mutant | |
|---|---|---|---|---|---|---|---|---|---|---|---|
| GCA | NI-NI-NI | + | GCC | NI-HD-NI | + | GCG | NN-HD-HD | + | GCT | NI-NG-NG | + |
| GCA | NI-HD-NG | + | GCC | NI-HD-NN | + | GCG | NN-NN-NN | + | GCT | NN-NI-HD | + |
| GCA | HD-HD-NN | + | GCC | NI-NN-HD | + | GCG | NN-NG-NG | + | GCT | NN-NI-NN | + |
| GCA | NN-NI-HD | + | GCC | NI-NG-HD | + | GCG | NG-NI-NN | + | GCT | NN-HD-NI | + |
| GCA | NG-NI-NI | + | GCC | HD-HD-NI | + | GCG | NG-HD-NI | + | GCT | NN-NG-HD | + |
| GCA | NG-NN-NI | + | GCC | HD-HD-NG | + | GCG | HD-HD-NN | ++ | GCT | NG-NI-NG | + |
| GCA | NG-NG-HD | + | GCC | HD-NN-HD | + | GCG | NN-NI-NN | ++ | GCT | NG-NN-NG | + |
| GCA | NG-NG-NN | + | GCC | NN-NG-NN | + | GCG | NN-NI-NG | ++ | GCT | NG-NG-NG | + |
| GCA | NI-HD-NN | ++ | GCC | NG-NI-HD | + | GCG | NN-HD-NG | ++ | GCT | NI-HD-NG | ++ |
| GCA | HD-HD-NI | ++ | GCC | NG-HD-NN | + | GCG | NN-NG-NN | ++ | GCT | HD-HD-NG | ++ |
| GCA | NN-NI-NN | ++ | GCC | NG-HD-NG | + | GCG | NG-HD-NN | ++ | GCT | NN-HD-HD | ++ |
| GCA | NN-NI-NG | ++ | GCC | NG-NN-HD | + | GCG | NI-HD-NN | +++ | GCT | NN-HD-NN | ++ |
| GCA | NN-HD-NG | ++ | GCC | NI-HD-NG | ++ | GCG | NN-HD-NI | +++ | GCT | NN-NN-NG | ++ |
| GCA | NN-NN-HD | ++ | GCC | HD-HD-HD | ++ | GCG | NN-HD-NN | +++ | GCT | NN-NG-NG | ++ |
| GCA | NN-NN-NN | ++ | GCC | NN-NI-HD | ++ | | | | GCT | NG-HD-NG | ++ |
| GCA | NN-NN-NG | ++ | GCC | NN-NI-NG | ++ | | | | GCT | NN-NI-NG | +++ |
| GCA | NN-NG-HD | ++ | GCC | NN-NG-NI | ++ | | | | GCT | NN-HD-NG | +++ |
| GCA | NN-NG-NN | ++ | GCC | NN-NG-NG | ++ | | | | | | |

TABLE 1J-continued

List of all tri-RVD members of any collection showing activity on specific pseudo-palindromic sequences targets

| target | mutant | | target | mutant | | target | mutant | | target | mutant | |
|---|---|---|---|---|---|---|---|---|---|---|---|
| GCA | NN-NG-NG | ++ | GCC | NG-HD-NI | ++ | | | | | | |
| GCA | NG-HD-HD | ++ | GCC | NG-NG-HD | ++ | | | | | | |
| GCA | NG-HD-NN | ++ | GCC | NI-HD-HD | +++ | | | | | | |
| GCA | NG-HD-NG | ++ | GCC | NN-HD-NI | +++ | | | | | | |
| GCA | NG-NN-NG | ++ | GCC | NN-HD-HD | +++ | | | | | | |
| GCA | NG-NG-NI | ++ | GCC | NN-HD-NN | +++ | | | | | | |
| GCA | NI-HD-NI | +++ | GCC | NN-HD-NG | +++ | | | | | | |
| GCA | NN-NI-NI | +++ | GCC | NN-NN-HD | +++ | | | | | | |
| GCA | NN-HD-NI | +++ | GCC | NN-NG-HD | +++ | | | | | | |
| GCA | NN-HD-HD | +++ | GCC | NG-HD-HD | +++ | | | | | | |
| GCA | NN-HD-NN | +++ | | | | | | | | | |
| GCA | NN-NN-NI | +++ | | | | | | | | | |
| GCA | NN-NG-NI | +++ | | | | | | | | | |
| GCA | NG-HD-NI | +++ | | | | | | | | | |

TABLE 1K

List of all tri-RVD members of any collection showing activity on specific pseudo-palindromic sequences targets

| target | mutant | | target | mutant | | target | mutant | | target | mutant | |
|---|---|---|---|---|---|---|---|---|---|---|---|
| GGA | NI-NN-NG | + | GGC | NI-NN-NI | + | GGG | NI-NG-NN | + | GGT | NI-NN-NG | + |
| GGA | NI-NG-NI | + | GGC | NI-NG-HD | + | GGG | HD-NN-NI | + | GGT | NI-NG-NG | + |
| GGA | NI-NG-NN | + | GGC | HD-NN-HD | + | GGG | NN-HD-NN | + | GGT | HD-NN-NG | + |
| GGA | HD-NN-NN | + | GGC | NN-NI-NN | + | GGG | NN-NN-HD | + | GGT | NN-NI-NI | + |
| GGA | NN-HD-NI | + | GGC | NN-HD-HD | + | GGG | NN-NG-NI | + | GGT | NN-HD-NG | + |
| GGA | NN-HD-NG | + | GGC | NN-HD-NG | + | GGG | NG-NI-NN | + | GGT | NN-NN-HD | + |
| GGA | NN-NG-HD | + | GGC | NN-NG-NN | + | GGG | NG-NN-NI | + | GGT | NN-NN-NN | + |
| GGA | NG-NN-HD | + | GGC | NG-NN-NI | + | GGG | NG-NN-NG | + | GGT | NN-NG-NI | + |
| GGA | NG-NG-NI | + | GGC | NG-NN-NN | + | GGG | NG-NG-NN | + | GGT | NN-NG-HD | + |
| GGA | NG-NG-NN | + | GGC | NI-NN-HD | ++ | GGG | NI-NN-NN | ++ | GGT | NG-NI-NG | + |
| GGA | NG-NG-NG | + | GGC | NN-NI-NI | ++ | GGG | HD-NN-NN | ++ | GGT | NG-NG-NG | + |
| GGA | NI-NN-NI | ++ | GGC | NN-NI-HD | ++ | GGG | NN-NI-NI | ++ | GGT | NN-NI-HD | ++ |
| GGA | NI-NN-NN | ++ | GGC | NN-NI-NG | ++ | GGG | NN-NI-NN | ++ | GGT | NN-NI-NN | ++ |
| GGA | HD-NN-NI | ++ | GGC | NN-NN-NN | ++ | GGG | NN-NI-NG | ++ | GGT | NN-NN-NI | ++ |
| GGA | NN-NI-HD | ++ | GGC | NN-NN-NG | ++ | GGG | NN-NG-NN | ++ | GGT | NN-NG-NG | ++ |
| GGA | NN-NI-NG | ++ | GGC | NN-NG-NI | ++ | GGG | NN-NG-NG | ++ | GGT | NN-NI-NG | +++ |
| GGA | NN-NN-HD | ++ | GGC | NN-NG-HD | ++ | GGG | NN-NN-NI | +++ | GGT | NN-NN-NG | +++ |
| GGA | NN-NG-NI | ++ | GGC | NN-NG-NG | ++ | GGG | NN-NN-NN | +++ | GGT | NG-NN-NG | +++ |
| GGA | NN-NG-NN | ++ | GGC | NG-NN-HD | ++ | GGG | NN-NN-NG | +++ | | | |
| GGA | NN-NG-NG | ++ | GGC | NG-NN-NG | ++ | GGG | NG-NN-NN | +++ | | | |
| GGA | NG-NN-NN | ++ | GGC | NG-NG-HD | ++ | | | | | | |
| GGA | NG-NN-NG | ++ | GGC | NN-NN-NI | +++ | | | | | | |
| GGA | NN-NI-NI | +++ | GGC | NN-NN-HD | +++ | | | | | | |
| GGA | NN-NI-NN | +++ | | | | | | | | | |
| GGA | NN-NN-NI | +++ | | | | | | | | | |
| GGA | NN-NN-NN | +++ | | | | | | | | | |
| GGA | NN-NN-NG | +++ | | | | | | | | | |
| GGA | NG-NN-NI | +++ | | | | | | | | | |

TABLE 1L

List of all tri-RVD members of any collection showing activity on specific pseudo-palindromic sequences targets

| target | mutant | | target | mutant | | target | mutant | | target | mutant | |
|---|---|---|---|---|---|---|---|---|---|---|---|
| GTA | NI-NI-HD | + | GTC | NI-HD-NI | + | GTG | NI-NI-HD | + | GTT | NI-NG-HD | + |
| GTA | NI-HD-NN | + | GTC | NI-HD-HD | + | GTG | NI-NG-NI | + | GTT | NI-NG-NN | + |
| GTA | HD-HD-NI | + | GTC | NI-HD-NG | + | GTG | NI-NG-NG | + | GTT | HD-NG-NG | + |
| GTA | NN-NI-NN | + | GTC | NI-NG-NN | + | GTG | NN-NI-NN | + | GTT | NN-NN-NG | + |
| GTA | NN-HD-NG | + | GTC | NN-NI-HD | + | GTG | NN-NI-NG | + | GTT | NG-NN-NG | + |
| GTA | NN-NN-HD | + | GTC | NN-HD-NI | + | GTG | NI-HD-NN | ++ | GTT | NG-NG-HD | + |
| GTA | NN-NN-NN | + | GTC | NN-HD-NG | + | GTG | NI-NN-NN | ++ | GTT | NI-HD-NG | ++ |
| GTA | NN-NN-NG | + | GTC | NG-NN-HD | + | GTG | HD-NG-NN | ++ | GTT | NN-NI-NG | ++ |

TABLE 1L-continued

List of all tri-RVD members of any collection showing activity on specific pseudo-palindromic sequences targets

| target | mutant | | target | mutant | | target | mutant | | target | mutant | |
|---|---|---|---|---|---|---|---|---|---|---|---|
| GTA | NG-HD-NI | + | GTC | NG-NG-NI | + | GTG | NN-HD-NI | ++ | GTT TABLE 1N-continued List of all tri-RVD members of any collection showing activity on specific pseudo-palindromic sequences targets

| target | mutant | | target | mutant | | target | mutant | | target | mutant | |
|---|---|---|---|---|---|---|---|---|---|---|---|
| TCA | NG-NN-NI | ++ | TCC | NG-NG-NG | ++ | TCG | NG-HD-NI | +++ | TCT | NG-HD-NN | ++ |
| TCA | NG-NN-NN | ++ | TCC | NG-HD-NI | +++ | TCG | NG-HD-HD | +++ | TCT | NG-NN-NG | ++ |
| TCA | NG-NN-NG | ++ | TCC | NG-HD-HD | +++ | TCG | NG-HD-NN | +++ | TCT | NG-HD-NG | +++ |
| TCA | NG-NG-HD | ++ | TCC | NG-HD-NN | +++ | | | | TCT | NG-NG-NG | +++ |
| TCA | NG-NG-NG | ++ | TCC | NG-HD-NG | +++ | | | | | | |
| TCA | NG-HD-NI | +++ | TCC | NG-NN-HD | +++ | | | | | | |
| TCA | NG-HD-HD | +++ | TCC | NG-NG-HD | +++ | | | | | | |
| TCA | NG-HD-NN | +++ | | | | | | | | | |
| TCA | NG-HD-NG | +++ | | | | | | | | | |
| TCA | NG-NG-NI | +++ | | | | | | | | | |
| TCA | NG-NG-NN | +++ | | | | | | | | | |

TABLE 1O

List of all tri-RVD members of any collection showing activity on specific pseudo-palindromic sequences targets

| target | mutant | | target | mutant | | target | mutant | | target | mutant | |
|---|---|---|---|---|---|---|---|---|---|---|---|
| GGA | NI-NN-NG | + | GGC | NI-NN-NI | + | GGG | NI-NG-NN | + | GGT | NI-NN-NG | + |
| GGA | NI-NG-NI | + | GGC | NI-NG-HD | + | GGG | HD-NN-NI | + | GGT | NI-NG-NG | + |
| GGA | NI-NG-NN | + | GGC | HD-NN-HD | + | GGG | NN-HD-NN | + | GGT | HD-NN-NG | + |
| GGA | HD-NN-NN | + | GGC | NN-NI-NN | + | GGG | NN-NN-HD | + | GGT | NN-NI-NI | + |
| GGA | NN-HD-NI | + | GGC | NN-HD-HD | + | GGG | NN-NG-NI | + | GGT | NN-HD-NG | + |
| GGA | NN-HD-NG | + | GGC | NN-HD-NG | + | GGG | NG-NI-NN | + | GGT | NN-NN-HD | + |
| GGA | NN-NG-HD | + | GGC | NN-NG-NN | + | GGG | NG-NN-NI | + | GGT | NN-NN-NN | + |
| GGA | NG-NN-HD | + | GGC | NG-NN-NI | + | GGG | NG-NN-NG | + | GGT | NN-NG-NI | + |
| GGA | NG-NG-NI | + | GGC | NG-NN-NN | + | GGG | NG-NG-NN | + | GGT | NN-NG-HD | + |
| GGA | NG-NG-NN | + | GGC | NI-NN-HD | ++ | GGG | NI-NN-NN | ++ | GGT | NG-NI-NG | + |
| GGA | NG-NG-NG | + | GGC | NN-NI-NI | ++ | GGG | HD-NN-NN | ++ | GGT | NG-NG-NG | + |
| GGA | NI-NN-NI | ++ | GGC | NN-NI-HD | ++ | GGG | NN-NI-NI | ++ | GGT | NN-NI-HD | ++ |
| GGA | NI-NN-NN | ++ | GGC | NN-NI-NG | ++ | GGG | NN-NI-NN | ++ | GGT | NN-NI-NN | ++ |
| GGA | HD-NN-NG | ++ | GGC | NN-NN-NN | ++ | GGG | NN-NN-NI | ++ | GGT | NN-NN-NI | ++ |
| GGA | NN-NI-HD | ++ | GGC | NN-NN-NG | ++ | GGG | NN-NG-NN | ++ | GGT | NN-NG-NG | ++ |
| GGA | NN-NI-NG | ++ | GGC | NN-NG-NI | ++ | GGG | NN-NG-NG | ++ | GGT | NN-NI-NG | +++ |
| GGA | NN-NN-HD | ++ | GGC | NN-NG-HD | ++ | GGG | NN-NN-NI | +++ | GGT | NN-NN-NG | +++ |
| GGA | NN-NG-NI | ++ | GGC | NN-NG-NG | ++ | GGG | NN-NN-NN | +++ | GGT | NG-NN-NG | +++ |
| GGA | NN-NG-NN | ++ | GGC | NG-NN-HD | ++ | GGG | NN-NN-NG | +++ | | | |
| GGA | NN-NG-NG | ++ | GGC | NG-NN-NG | ++ | GGG | NG-NN-NN | +++ | | | |
| GGA | NG-NN-NN | ++ | GGC | NG-NG-HD | ++ | | | | | | |
| GGA | NG-NN-NG | ++ | GGC | NN-NN-NI | +++ | | | | | | |
| GGA | NN-NI-NI | +++ | GGC | NN-NN-HD | +++ | | | | | | |
| GGA | NN-NI-NN | +++ | | | | | | | | | |
| GGA | NN-NN-NI | +++ | | | | | | | | | |
| GGA | NN-NN-NN | +++ | | | | | | | | | |
| GGA | NN-NN-NG | +++ | | | | | | | | | |
| GGA | NG-NN-NI | +++ | | | | | | | | | |

TABLE 1P

List of all tri-RVD members of any collection showing activity on specific pseudo-palindromic sequences targets

| target | mutant | | target | mutant | | target | mutant | | target | mutant | |
|---|---|---|---|---|---|---|---|---|---|---|---|
| GTA | NI-NI-HD | + | GTC | NI-HD-NI | + | GTG | NI-NI-HD | + | GTT | NI-NG-HD | + |
| GTA | NI-HD-NN | + | GTC | NI-HD-HD | + | GTG | NI-NG-NI | + | GTT | NI-NG-NN | + |
| GTA | HD-HD-NI | + | GTC | NI-HD-NG | + | GTG | NI-NG-NG | + | GTT | HD-NG-NG | + |
| GTA | NN-NI-NN | + | GTC | NI-NG-NN | + | GTG | NN-NI-NN | + | GTT | NN-NN-NG | + |
| GTA | NN-HD-NG | + | GTC | NN-NI-HD | + | GTG | NN-NI-NG | + | GTT | NG-NG-NG | + |
| GTA | NN-NN-HD | + | GTC | NN-HD-NI | + | GTG | NI-HD-NN | ++ | GTT | NG-NG-HD | + |
| GTA | NN-NN-NN | + | GTC | NN-HD-NG | + | GTG | NI-NN-NN | ++ | GTT | NI-HD-NG | ++ |
| GTA | NN-NN-NG | + | GTC | NG-NN-HD | + | GTG | HD-NG-NN | ++ | GTT | NN-NI-NG | ++ |
| GTA | NG-HD-NI | + | GTC | NG-NG-NI | + | GTG | NN-HD-NI | ++ | GTT | NN-HD-NG | ++ |
| GTA | NG-NN-NG | + | GTC | NI-NN-HD | ++ | GTG | NN-HD-NN | ++ | GTT | NN-NG-NI | ++ |
| GTA | NI-NG-HD | ++ | GTC | NI-NG-NI | ++ | GTG | NN-NN-NN | ++ | GTT | NN-NG-HD | ++ |

TABLE 1P-continued

List of all tri-RVD members of any collection showing activity on specific pseudo-palindromic sequences targets

| target | mutant | | target | mutant | | target | mutant | | target | mutant | |
|---|---|---|---|---|---|---|---|---|---|---|---|
| GTA | NI-NG-NN | ++ | GTC | NI-NG-NG | ++ | GTG | NN-NG-HD | ++ | GTT | NN-NG-NN | ++ |
| GTA | NI-NG-NG | ++ | GTC | HD-NG-HD | ++ | GTG | NG-NG-NI | ++ | GTT | NI-NG-NG | +++ |
| GTA | HD-NG-NI | ++ | GTC | NN-NI-NG | ++ | GTG | NG-NG-NG | ++ | GTT | NN-NG-NG | +++ |
| GTA | NN-NI-NI | ++ | GTC | NN-HD-HD | ++ | GTG | NI-NG-NN | +++ | GTT | NG-NG-NG | +++ |
| GTA | NN-NI-NG | ++ | GTC | NN-NN-HD | ++ | GTG | NN-NG-NI | +++ | | | |
| GTA | NN-NN-NI | ++ | GTC | NN-NG-NN | ++ | GTG | NN-NG-NN | +++ | | | |
| GTA | NG-NG-HD | ++ | GTC | NG-HD-HD | ++ | GTG | NN-NG-NG | +++ | | | |
| GTA | NG-NG-NG | ++ | GTC | NG-NG-NG | ++ | GTG | NG-NG-NN | +++ | | | |
| GTA | NI-HD-NI | +++ | GTC | NI-NG-HD | +++ | | | | | | |
| GTA | NI-NG-NI | +++ | GTC | NN-NG-NI | +++ | | | | | | |
| GTA | NN-HD-NI | +++ | GTC | NN-NG-HD | +++ | | | | | | |
| GTA | NN-NG-NI | +++ | GTC | NN-NG-NG | +++ | | | | | | |
| GTA | NN-NG-HD | +++ | GTC | NG-NG-HD | +++ | | | | | | |
| GTA | NN-NG-NN | +++ | | | | | | | | | |
| GTA | NN-NG-NG | +++ | | | | | | | | | |
| GTA | NG-NG-NI | +++ | | | | | | | | | |
| GTA | NG-NG-NN | +++ | | | | | | | | | |

TABLE 1Q

List of all tri-RVD members of any collection showing activity on specific pseudo-palindromic sequences targets

| target | mutant | | target | mutant | | target | mutant | | target | mutant | |
|---|---|---|---|---|---|---|---|---|---|---|---|
| TAA | HD-NI-NI | + | TAC | NI-NI-HD | + | TAG | NI-NI-NN | + | TAT | NI-NI-NG | + |
| TAA | NN-NI-NI | + | TAC | NN-NI-HD | + | TAG | NN-NI-NN | + | TAT | HD-NI-NG | + |
| TAA | NN-NI-NN | + | TAC | NN-HD-HD | + | TAG | HD-NI-NN | ++ | TAT | NN-NG-NG | + |
| TAA | NN-NI-NG | + | TAC | NN-NN-HD | + | TAG | NG-NI-NI | ++ | TAT | NG-HD-HD | + |
| TAA | NN-NG-NI | + | TAC | NN-NG-HD | + | TAG | NG-NI-HD | ++ | TAT | NG-NN-NN | + |
| TAA | NG-NG-HD | ++ | TAC | NG-NG-NN | + | TAG | NG-NI-NG | ++ | TAT | NG-NG-HD | + |
| TAA | NG-NI-NI | +++ | TAC | HD-NI-HD | ++ | TAG | NG-HD-HD | ++ | TAT | HD-NG-NI | ++ |
| TAA | NG-NI-HD | +++ | TAC | NG-NI-NI | ++ | TAG | NG-HD-NG | ++ | TAT | NN-NI-NG | ++ |
| TAA | NG-NI-NN | +++ | TAC | NG-NN-NI | ++ | TAG | NG-NG-NI | ++ | TAT | NG-NI-HD | ++ |
| TAA | NG-NI-NG | +++ | TAC | NG-NG-NI | ++ | TAG | NG-NG-NG | ++ | TAT | NG-NI-NN | +++ |
| TAA | NG-HD-NI | +++ | TAC | NG-NG-NG | ++ | TAG | NG-NI-NN | +++ | TAT | NG-NI-NG | +++ |
| TAA | NG-HD-HD | +++ | TAC | NG-NI-HD | +++ | TAG | NG-HD-NI | +++ | TAT | NG-HD-NG | +++ |
| TAA | NG-HD-NN | +++ | TAC | NG-NI-NN | +++ | TAG | NG-HD-NN | +++ | TAT | NG-NN-NG | +++ |
| TAA | NG-HD-NG | +++ | TAC | NG-NI-NG | +++ | TAG | NG-NN-NI | +++ | TAT | NG-NG-NG | +++ |
| TAA | NG-NN-NI | +++ | TAC | NG-HD-NI | +++ | TAG | NG-NN-NN | +++ | | | |
| TAA | NG-NN-HD | +++ | TAC | NG-HD-HD | +++ | TAG | NG-NN-NG | +++ | | | |
| TAA | NG-NN-NN | +++ | TAC | NG-HD-NN | +++ | TAG | NG-NG-NN | +++ | | | |
| TAA | NG-NN-NG | +++ | TAC | NG-HD-NG | +++ | | | | | | |
| TAA | NG-NG-NI | +++ | TAC | NG-NN-HD | +++ | | | | | | |
| TAA | NG-NG-NN | +++ | TAC | NG-NN-NN | +++ | | | | | | |
| TAA | NG-NG-NG | +++ | TAC | NG-NN-NG | +++ | | | | | | |
| | | | TAC | NG-NG-HD | +++ | | | | | | |

TABLE 1R

List of all tri-RVD members of any collection showing activity on specific pseudo-palindromic sequences targets

| target | mutant | | target | mutant | | target | mutant | | target | mutant | |
|---|---|---|---|---|---|---|---|---|---|---|---|
| TCA | HD-HD-NI | + | TCC | HD-NG-HD | + | TCG | NG-NG-NG | + | TCT | HD-HD-NG | + |
| TCA | NN-HD-NN | + | TCC | NG-NI-NG | + | TCG | HD-NI-HD | ++ | TCT | NN-NI-NG | + |
| TCA | NG-NI-NI | + | TCC | NG-NN-NG | + | TCG | HD-HD-NN | ++ | TCT | NN-NG-NG | + |
| TCA | NG-NI-HD | + | TCC | NG-NG-NI | + | TCG | NN-HD-NN | ++ | TCT | NG-HD-NI | + |
| TCA | NG-NI-NN | + | TCC | NG-NG-NN | + | TCG | NG-NI-NN | ++ | KT | HD-NG-NI | ++ |
| TCA | NG-NI-NG | + | TCC | HD-HD-HD | ++ | TCG | NG-HD-NG | ++ | TCT | NN-HD-NG | ++ |
| TCA | NG-NN-HD | + | TCC | NN-HD-HD | ++ | TCG | NG-NN-NN | ++ | TCT | NG-NI-NG | ++ |
| TCA | NN-HD-NI | ++ | TCC | NG-NI-HD | ++ | TCG | NG-NG-NN | ++ | TCT | NG-HD-HD | ++ |
| TCA | NG-NN-NI | ++ | TCC | NG-NG-NG | ++ | TCG | NG-HD-NI | +++ | TCT | NG-HD-NN | ++ |
| TCA | NG-NN-NN | ++ | TCC | NG-HD-NI | +++ | TCG | NG-HD-HD | +++ | TCT | NG-NN-NG | ++ |
| TCA | NG-NN-NG | ++ | TCC | NG-HD-HD | +++ | TCG | NG-HD-NN | +++ | TCT | NG-HD-NG | +++ |

TABLE 1R-continued

List of all tri-RVD members of any collection showing activity on specific pseudo-palindromic sequences targets

| target | mutant | | target | mutant | | target | mutant | | target | mutant | |
|---|---|---|---|---|---|---|---|---|---|---|---|
| TCA | NG-NG-HD | ++ | TCC | NG-HD-NN | +++ | | | | TCT | NG-NG-NG | +++ |
| TCA | NG-NG-NG | ++ | TCC | NG-HD-NG | +++ | | | | | | |
| TCA | NG-HD-NI | +++ | TCC | NG-NN-HD | +++ | | | | | | |
| TCA | NG-HD-HD | +++ | TCC | NG-NG-HD | +++ | | | | | | |
| TCA | NG-HD-NN | +++ | | | | | | | | | |
| TCA | NG-HD-NG | +++ | | | | | | | | | |
| TCA | NG-NG-NI | +++ | | | | | | | | | |
| TCA | NG-NG-NN | +++ | | | | | | | | | |

TABLE 1S

List of all tri-RVD members of any collection showing activity on specific pseudo-palindromic sequences targets

| target | mutant | | target | mutant | | target | mutant | | target | mutant | |
|---|---|---|---|---|---|---|---|---|---|---|---|
| TGA | NI-NN-NI | + | TGC | HD-NN-HD | + | TGG | NI-NN-NN | + | TGT | HD-NN-NG | + |
| TGA | NI-NN-NN | + | TGC | NN-NN-HD | + | TGG | HD-NN-NN | + | TGT | NN-NG-NG | + |
| TGA | HD-NN-NI | + | TGC | NG-NI-NI | + | TGG | NN-NN-NN | + | TGT | NG-NI-HD | + |
| TGA | HD-NN-NN | + | TGC | NG-NI-NG | + | TGG | NG-NI-NG | + | TGT | NG-NI-NN | + |
| TGA | NN-NN-NI | + | TGC | NG-HD-NI | + | TGG | NG-NI-NI | + | TGT | NG-NN-NI | + |
| TGA | NN-NN-NN | + | TGC | NG-HD-NG | + | TGG | NG-NN-HD | + | TGT | NG-NN-HD | + |
| TGA | NN-NG-NI | + | TGC | NG-NG-NI | + | TGG | NG-NG-NN | + | TGT | NG-NG-HD | + |
| TGA | NG-NI-HD | + | TGC | NG-NG-NN | + | TGG | NG-NG-NG | + | TGT | NN-NI-NG | ++ |
| TGA | NG-NI-NN | + | TGC | NG-NG-NG | + | TGG | NG-NI-NN | ++ | TGT | NG-HD-NG | ++ |
| TGA | NG-NG-HD | + | TGC | NG-NI-HD | ++ | TGG | NG-HD-NN | ++ | TGT | NG-NN-NN | ++ |
| TGA | NG-NI-NI | ++ | TGC | NG-HD-HD | +++ | TGG | NG-NN-NI | +++ | TGT | NG-NI-NG | +++ |
| TGA | NG-NI-NN | ++ | TGC | NG-NN-NI | +++ | TGG | NG-NN-NN | +++ | TGT | NG-NN-NG | +++ |
| TGA | NG-NI-NG | ++ | TGC | NG-NN-HD | +++ | TGG | NG-NN-NG | +++ | TGT | NG-NG-NG | +++ |
| TGA | NG-HD-NI | ++ | TGC | NG-NN-NN | +++ | | | | | | |
| TGA | NG-NG-NN | ++ | TGC | NG-NN-NG | +++ | | | | | | |
| TGA | NG-NG-NG | ++ | TGC | NG-NG-HD | +++ | | | | | | |
| TGA | NG-NN-NI | +++ | | | | | | | | | |
| TGA | NG-NN-HD | +++ | | | | | | | | | |
| TGA | NG-NN-NN | +++ | | | | | | | | | |
| TGA | NG-NN-NG | +++ | | | | | | | | | |
| TGA | NG-NG-NI | +++ | | | | | | | | | |

TABLE 1T

List of all tri-RVD members of any collection showing activity on specific pseudo-palindromic sequences targets

| target | mutant | | target | mutant | | target | mutant | | target | mutant | |
|---|---|---|---|---|---|---|---|---|---|---|---|
| TTA | NI-NI-HD | + | TTC | NG-HD-NI | + | TTG | NI-NI-HD | + | TTT | NI-NG-NG | + |
| TTA | NI-NG-NI | + | TTC | NG-NN-NG | + | TTG | NI-NG-NN | + | TTT | NN-NG-NG | + |
| TTA | NN-NG-HD | + | TTC | NG-NG-NI | + | TTG | HD-NG-NN | + | TTT | NG-NI-NG | + |
| TTA | NN-NG-NG | + | TTC | NI-NG-HD | ++ | TTG | NN-NG-NN | + | TTT | NG-NG-HD | + |
| TTA | NG-HD-HD | + | TTC | HD-NG-HD | ++ | TTG | NG-HD-NI | + | TTT | NG-NG-NN | + |
| TTA | NG-HD-NN | + | TTC | NN-NG-HD | ++ | TTG | NG-NN-NN | + | TTT | NG-HD-NG | ++ |
| TTA | NN-NG-NI | ++ | TTC | NG-HD-NG | ++ | TTG | NG-NN-NG | + | TTT | NG-NN-NG | ++ |
| TTA | NG-HD-NG | ++ | TTC | NG-NN-HD | ++ | TTG | NG-NG-HD | + | TTT | NG-NG-NG | +++ |
| TTA | NG-NN-HD | ++ | TTC | NG-NG-NN | ++ | TTG | NG-HD-NN | ++ | | | |
| TTA | NG-NN-NG | ++ | TTC | NG-HD-HD | +++ | TTG | NG-NG-NI | ++ | | | |
| TTA | NG-HD-NI | +++ | TTC | NG-NG-HD | +++ | TTG | NG-NG-NN | +++ | | | |
| TTA | NG-NG-NI | +++ | TTC | NG-NG-NG | +++ | TTG | NG-NG-NG | +++ | | | |
| TTA | NG-NG-HD | +++ | | | | | | | | | |
| TTA | NG-NG-NN | +++ | | | | | | | | | |
| TTA | NG-NG-NG | +++ | | | | | | | | | |

TABLE 2A

List of all tri-base containing pseudo-palindromic sequences targets

| mutant | target | | mutant | target | | mutant | target | | mutant | target | |
|---|---|---|---|---|---|---|---|---|---|---|---|
| NI-NI-NI | AGA | + | NI-NI-HD | AAG | + | NI-NI-NN | AAT | + | NI-NI-NG | ACT | + |
| NI-NI-NI | ATA | + | NI-NI-HD | ACC | + | NI-NI-NN | AGA | + | NI-NI-NG | AGA | + |
| NI-NI-NI | GAA | + | NI-NI-HD | ATA | + | NI-NI-NN | AGG | + | NI-NI-NG | AGT | + |
| NI-NI-NI | GCA | + | NI-NI-HD | ATG | + | NI-NI-NN | AGT | + | NI-NI-NG | TAT | + |
| NI-NI-NI | ACA | ++ | NI-NI-HD | CAC | + | NI-NI-NN | GAA | + | NI-NI-NG | AAA | ++ |
| NI-NI-NI | AAA | +++ | NI-NI-HD | CTA | + | NI-NI-NN | TAG | + | NI-NI-NG | AAC | ++ |
| | | | NI-NI-HD | GAC | + | NI-NI-NN | AAC | ++ | NI-NI-NG | AAG | ++ |
| | | | NI-NI-HD | GTA | + | NI-NI-NN | ACG | ++ | NI-NI-NG | ATT | ++ |
| | | | NI-NI-HD | GTG | + | NI-NI-NN | CAG | ++ | NI-NI-NG | CAT | ++ |
| | | | NI-NI-HD | TAC | + | NI-NI-NN | GAG | ++ | NI-NI-NG | GAT | ++ |
| | | | NI-NI-HD | TTA | + | NI-NI-NN | AAA | +++ | NI-NI-NG | AAT | +++ |
| | | | NI-NI-HD | TTG | + | NI-NI-NN | AAG | +++ | | | |
| | | | NI-NI-HD | AAA | ++ | | | | | | |
| | | | NI-NI-HD | AAC | +++ | | | | | | |

TABLE 2B

List of all tri-base containing pseudo-palindromic sequences targets

| mutant | target | | mutant | target | | mutant | target | | mutant | target | |
|---|---|---|---|---|---|---|---|---|---|---|---|
| NI-HD-NI | AAC | + | NI-HD-HD | ACG | + | NI-HD-NN | AGA | + | NI-HD-NG | AGT | + |
| NI-HD-NI | CAT | + | NI-HD-HD | AGC | + | NI-HD-NN | AGG | + | NI-HD-NG | ATG | + |
| NI-HD-NI | CTA | + | NI-HD-HD | ATC | + | NI-HD-NN | ATA | + | NI-HD-NG | CTT | + |
| NI-HD-NI | GCC | + | NI-HD-HD | CAA | + | NI-HD-NN | CAG | + | NI-HD-NG | GAT | + |
| NI-HD-NI | GTC | + | NI-HD-HD | CAC | + | NI-HD-NN | CCA | + | NI-HD-NG | GCA | + |
| NI-HD-NI | ATC | ++ | NI-HD-HD | GAC | + | NI-HD-NN | CTG | + | NI-HD-NG | GTC | + |
| NI-HD-NI | ATG | ++ | NI-HD-HD | GTC | + | NI-HD-NN | GM | + | NI-HD-NG | AAG | ++ |
| NI-HD-NI | ATT | ++ | NI-HD-HD | AAA | ++ | NI-HD-NN | GAG | + | NI-HD-NG | ATA | ++ |
| NI-HD-NI | CCA | ++ | NI-HD-HD | ACT | ++ | NI-HD-NN | GCC | + | NI-HD-NG | ATC | ++ |
| NI-HD-NI | AAA | +++ | NI-HD-HD | CCC | ++ | NI-HD-NN | GTA | + | NI-HD-NG | ATT | ++ |
| NI-HD-NI | ACA | +++ | NI-HD-HD | AAC | +++ | NI-HD-NN | AAC | ++ | NI-HD-NG | CAT | ++ |
| NI-HD-NI | ACC | +++ | NI-HD-HD | ACA | +++ | NI-HD-NN | ACT | ++ | NI-HD-NG | CCC | ++ |
| NI-HD-NI | ACG | +++ | NI-HD-HD | ACC | +++ | NI-HD-NN | ATG | ++ | NI-HD-NG | CCT | ++ |
| NI-HD-NI | ATA | +++ | NI-HD-HD | GCC | +++ | NI-HD-NN | CCG | ++ | NI-HD-NG | GCC | ++ |
| NI-HD-NI | GCA | +++ | | | | NI-HD-NN | GCA | ++ | NI-HD-NG | GCT | ++ |
| NI-HD-NI | GTA | +++ | | | | NI-HD-NN | GTG | ++ | NI-HD-NG | GTT | ++ |
| | | | | | | NI-HD-NN | AAA | +++ | NI-HD-NG | AAA | +++ |
| | | | | | | NI-HD-NN | AAG | +++ | NI-HD-NG | AAC | +++ |
| | | | | | | NI-HD-NN | ACA | +++ | NI-HD-NG | AAT | +++ |
| | | | | | | NI-HD-NN | ACC | +++ | NI-HD-NG | ACA | +++ |
| | | | | | | NI-HD-NN | ACG | +++ | NI-HD-NG | ACC | +++ |
| | | | | | | NI-HD-NN | GCG | +++ | NI-HD-NG | ACG | +++ |
| | | | | | | | | | NI-HD-NG | ACT | +++ |

TABLE 2C

List of all tri-base containing pseudo-palindromic sequences targets

| mutant | target | | mutant | target | | mutant | target | | mutant | target | |
|---|---|---|---|---|---|---|---|---|---|---|---|
| NI-NN-NI | AAC | + | NI-NN-HD | AGT | + | NI-NN-NN | ACG | + | NI-NN-NG | ACT | + |
| NI-NN-NI | AGT | + | NI-NN-HD | ATA | + | NI-NN-NN | ATA | + | NI-NN-NG | ATT | + |
| NI-NN-NI | ATA | + | NI-NN-HD | GAA | + | NI-NN-NN | CAA | + | NI-NN-NG | GGA | + |
| NI-NN-NI | CAA | + | NI-NN-HD | GCC | + | NI-NN-NN | CAG | + | NI-NN-NG | GGT | + |
| NI-NN-NI | CGC | + | NI-NN-HD | ACC | ++ | NI-NN-NN | TGA | + | NI-NN-NG | AAG | ++ |
| NI-NN-NI | GGC | + | NI-NN-HD | ATC | ++ | NI-NN-NN | TGG | + | NI-NN-NG | ACA | ++ |
| NI-NN-NI | TGA | + | NI-NN-HD | CAC | ++ | NI-NN-NN | AAC | ++ | NI-NN-NG | AGG | ++ |
| NI-NN-NI | AAG | ++ | NI-NN-HD | CGC | ++ | NI-NN-NN | AGC | ++ | NI-NN-NG | ATA | ++ |
| NI-NN-NI | AGG | ++ | NI-NN-HD | GAC | ++ | NI-NN-NN | AGT | ++ | NI-NN-NG | CAT | ++ |
| NI-NN-NI | CGA | ++ | NI-NN-HD | GGC | ++ | NI-NN-NN | ATG | ++ | NI-NN-NG | CGT | ++ |
| NI-NN-NI | GAA | ++ | NI-NN-HD | GTC | ++ | NI-NN-NN | CGA | ++ | NI-NN-NG | GAA | ++ |
| NI-NN-NI | GGA | ++ | NI-NN-HD | AAA | +++ | NI-NN-NN | CGG | ++ | NI-NN-NG | GAT | ++ |
| NI-NN-NI | AAA | +++ | NI-NN-HD | AAC | +++ | NI-NN-NN | GAA | ++ | NI-NN-NG | AAA | +++ |
| NI-NN-NI | AGA | +++ | NI-NN-HD | AGA | +++ | NI-NN-NN | GAG | ++ | NI-NN-NG | AAC | +++ |

TABLE 2C-continued

List of all tri-base containing pseudo-palindromic sequences targets

| mutant | target | | mutant | target | | mutant | target | | mutant | target | |
|---|---|---|---|---|---|---|---|---|---|---|---|
| NI-NN-NI | AGC | +++ | NI-NN-HD | AGC | +++ | NI-NN-NN | GGA | ++ | NI-NN-NG | AAT | +++ |
| | | | | | | NI-NN-NN | GGG | ++ | NI-NN-NG | AGA | +++ |
| | | | | | | NI-NN-NN | GTG | ++ | NI-NN-NG | AGC | +++ |
| | | | | | | NI-NN-NN | AAA | +++ | NI-NN-NG | AGT | +++ |
| | | | | | | NI-NN-NN | AAG | +++ | | | |
| | | | | | | NI-NN-NN | AGA | +++ | | | |
| | | | | | | NI-NN-NN | AGG | +++ | | | |

TABLE 2D

List of all tri-base containing pseudo-palindromic sequences targets

| mutant | target | | mutant | target | | mutant | target | | mutant | target | |
|---|---|---|---|---|---|---|---|---|---|---|---|
| NI-NG-NI | AAC | + | NI-NG-HD | ATT | + | NI-NG-NN | AAC | + | NI-NG-NG | AAG | + |
| NI-NG-NI | AGG | + | NI-NG-HD | CGC | + | NI-NG-NN | AGC | + | NI-NG-NG | ACA | + |
| NI-NG-NI | ATT | + | NI-NG-HD | GCC | + | NI-NG-NN | AGT | + | NI-NG-NG | ACC | + |
| NI-NG-NI | CAA | + | NI-NG-HD | GGC | + | NI-NG-NN | CAG | + | NI-NG-NG | AGC | + |
| NI-NG-NI | CAC | + | NI-NG-HD | GTT | + | NI-NG-NN | CTA | + | NI-NG-NG | AGG | + |
| NI-NG-NI | CAG | + | NI-NG-HD | ACA | ++ | NI-NG-NN | GAA | + | NI-NG-NG | CAT | + |
| NI-NG-NI | CAT | + | NI-NG-HD | AGC | ++ | NI-NG-NN | GAG | + | NI-NG-NG | CCT | + |
| NI-NG-NI | CCA | + | NI-NG-HD | ATG | ++ | NI-NG-NN | GGA | + | NI-NG-NG | CGT | + |
| NI-NG-NI | CCT | + | NI-NG-HD | CAC | ++ | NI-NG-NN | GGG | + | NI-NG-NG | CTA | + |
| NI-NG-NI | CGA | + | NI-NG-HD | CCC | ++ | NI-NG-NN | GTC | + | NI-NG-NG | CTC | + |
| NI-NG-NI | CGT | + | NI-NG-HD | CTA | ++ | NI-NG-NN | GTT | + | NI-NG-NG | GAA | + |
| NI-NG-NI | CTG | + | NI-NG-HD | GAC | ++ | NI-NG-NN | TTG | ++ | NI-NG-NG | GAC | + |
| NI-NG-NI | GAC | + | NI-NG-HD | GTA | ++ | NI-NG-NN | AAA | ++ | NI-NG-NG | GAT | + |
| NI-NG-NI | GGA | + | NI-NG-HD | TTC | ++ | NI-NG-NN | ACA | ++ | NI-NG-NG | GCT | + |
| NI-NG-NI | GTG | + | NI-NG-HD | AAA | +++ | NI-NG-NN | ACG | ++ | NI-NG-NG | GGT | + |
| NI-NG-NI | TTA | + | NI-NG-HD | AAC | +++ | NI-NG-NN | AGA | ++ | NI-NG-NG | GTG | + |
| NI-NG-NI | AAG | ++ | NI-NG-HD | ACC | +++ | NI-NG-NN | AGG | ++ | NI-NG-NG | TTT | + |
| NI-NG-NI | ACA | ++ | NI-NG-HD | ATA | +++ | NI-NG-NN | ATT | ++ | NI-NG-NG | AAA | ++ |
| NI-NG-NI | AGA | ++ | NI-NG-HD | ATC | +++ | NI-NG-NN | GTA | +++ | NI-NG-NG | AAC | ++ |
| NI-NG-NI | AGC | ++ | NI-NG-HD | CTC | +++ | NI-NG-NN | AAG | +++ | NI-NG-NG | ACT | ++ |
| NI-NG-NI | ATC | ++ | NI-NG-HD | GTC | +++ | NI-NG-NN | ATA | +++ | NI-NG-NG | AGA | ++ |
| NI-NG-NI | GAA | ++ | | | | NI-NG-NN | ATC | +++ | NI-NG-NG | AGT | ++ |
| NI-NG-NI | GTC | ++ | | | | NI-NG-NN | ATG | +++ | NI-NG-NG | CTT | ++ |
| NI-NG-NI | AAA | +++ | | | | NI-NG-NN | CTG | +++ | NI-NG-NG | GTA | ++ |
| NI-NG-NI | ATA | +++ | | | | NI-NG-NN | GTG | +++ | NI-NG-NG | GTC | ++ |
| NI-NG-NI | ATG | +++ | | | | | | | NI-NG-NG | AAT | +++ |
| NI-NG-NI | CTA | +++ | | | | | | | NI-NG-NG | ATA | +++ |
| NI-NG-NI | GTA | +++ | | | | | | | NI-NG-NG | ATC | +++ |
| | | | | | | | | | NI-NG-NG | ATG | +++ |
| | | | | | | | | | NI-NG-NG | ATT | +++ |
| | | | | | | | | | NI-NG-NI | GTT | +++ |

TABLE 2E

List of all tri-base containing pseudo-palindromic sequences targets

| mutant | target | | mutant | target | | mutant | target | | mutant | target | |
|---|---|---|---|---|---|---|---|---|---|---|---|
| HD-NI-NI | AAA | + | HD-NI-HD | ACC | + | HD-NI-NN | AAT | + | HD-NI-NG | AAA | + |
| HD-NI-NI | ACA | + | HD-NI-HD | AGC | + | HD-NI-NN | AGA | + | HD-NI-NG | AAG | + |
| HD-NI-NI | CCG | + | HD-NI-HD | ATA | + | HD-NI-NN | AGG | + | HD-NI-NG | ACT | + |
| HD-NI-NI | CGC | + | HD-NI-HD | GAC | + | HD-NI-NN | AGT | + | HD-NI-NG | AGA | + |
| HD-NI-NI | CGG | + | HD-NI-HD | AAC | ++ | HD-NI-NN | CCA | + | HD-NI-NG | CAA | + |
| HD-NI-NI | TAA | + | HD-NI-HD | CAA | ++ | HD-NI-NN | CCT | + | HD-NI-NG | CAG | + |
| HD-NI-NI | CCC | ++ | HD-NI-HD | CAT | ++ | HD-NI-NN | CGA | + | HD-NI-NG | CCA | + |
| HD-NI-NI | CGA | ++ | HD-NI-HD | CCA | ++ | HD-NI-NN | CGG | + | HD-NI-NG | CCC | + |
| HD-NI-NI | CAA | +++ | HD-NI-HD | CCT | ++ | HD-NI-NN | CGT | + | HD-NI-NG | CGA | + |
| HD-NI-NI | CAC | +++ | HD-NI-HD | CGC | ++ | HD-NI-NN | AAA | ++ | HD-NI-NG | CTC | + |
| HD-NI-NI | CAG | +++ | HD-NI-HD | CGT | ++ | HD-NI-NN | CAA | ++ | HD-NI-NG | CTT | + |
| HD-NI-NI | CCA | +++ | HD-NI-HD | TAC | ++ | HD-NI-NN | CAC | ++ | HD-NI-NG | GAT | + |
| HD-NI-NI | CTA | +++ | HD-NI-HD | TCG | ++ | HD-NI-NN | CAT | ++ | HD-NI-NG | TAT | + |
| | | | HD-NI-HD | CAC | +++ | HD-NI-NN | CCG | ++ | HD-NI-NG | AAT | ++ |
| | | | HD-NI-HD | CCC | +++ | HD-NI-NN | TAG | ++ | HD-NI-NG | AGT | ++ |

TABLE 2E-continued

List of all tri-base containing pseudo-palindromic sequences targets

| mutant | target | | mutant | target | | mutant | target | | mutant | target | |
|---|---|---|---|---|---|---|---|---|---|---|---|
| | | | | | | HD-NI-NN | AAG | +++ | HD-NI-NG | CAC | ++ |
| | | | | | | HD-NI-NN | CAG | +++ | HD-NI-NG | CCT | ++ |
| | | | | | | | | | HD-NI-NG | CGT | ++ |
| | | | | | | | | | HD-NI-NG | CAT | +++ |

TABLE 2F

List of all tri-base containing pseudo-palindromic sequences targets

| mutant | target | | mutant | target | | mutant | target | | mutant | target | |
|---|---|---|---|---|---|---|---|---|---|---|---|
| HD-HD-NI | AAA | + | HD-HD-HD | ACA | + | HD-HD-NN | AAA | + | HD-HD-NG | AAA | + |
| HD-HD-NI | AAC | + | HD-HD-HD | ACT | + | HD-HD-NN | AAC | + | HD-HD-NG | AAC | + |
| HD-HD-NI | CAG | + | HD-HD-HD | AGC | + | HD-HD-NN | ACT | + | HD-HD-NG | ACA | + |
| HD-HD-NI | CGA | + | HD-HD-HD | ATC | + | HD-HD-NN | AGA | + | HD-HD-NG | ACG | + |
| HD-HD-NI | CTC | + | HD-HD-HD | CCG | + | HD-HD-NN | AGG | + | HD-HD-NG | AGT | + |
| HD-HD-NI | GCC | + | HD-HD-HD | AAC | ++ | HD-HD-NN | ATG | + | HD-HD-NG | ATT | + |
| HD-HD-NI | GTA | + | HD-HD-HD | CGC | ++ | HD-HD-NN | CAT | + | HD-HD-NG | CAA | + |
| HD-HD-NI | TCA | + | HD-HD-HD | CTC | ++ | HD-HD-NN | CGG | + | HD-HD-NG | CAG | + |
| HD-HD-NI | ACG | ++ | HD-HD-HD | GCC | ++ | HD-HD-NN | CTA | + | HD-HD-NG | CGT | + |
| HD-HD-NI | ATA | ++ | HD-HD-HD | TCC | ++ | HD-HD-NN | GCA | + | HD-HD-NG | GCC | + |
| HD-HD-NI | CAA | ++ | HD-HD-HD | ACC | +++ | HD-HD-NN | AAG | ++ | HD-HD-NG | TCT | + |
| HD-HD-NI | CAC | ++ | HD-HD-HD | CAC | +++ | HD-HD-NN | ACA | ++ | HD-HD-NG | AAT | ++ |
| HD-HD-NI | CCT | ++ | HD-HD-HD | CCA | +++ | HD-HD-NN | ACC | ++ | HD-HD-NG | ACC | ++ |
| HD-HD-NI | CTG | ++ | HD-HD-HD | CCC | +++ | HD-HD-NN | CAA | ++ | HD-HD-NG | CAC | ++ |
| HD-HD-NI | GCA | ++ | HD-HD-HD | CCT | +++ | HD-HD-NN | CAC | ++ | HD-HD-NG | CCA | ++ |
| HD-HD-NI | ACA | +++ | | | | HD-HD-NN | CCT | ++ | HD-HD-NG | CCG | ++ |
| HD-HD-NI | ACC | +++ | | | | HD-HD-NN | CTG | ++ | HD-HD-NG | CTC | ++ |
| HD-HD-NI | CCA | +++ | | | | HD-HD-NN | GCG | ++ | HD-HD-NG | CTT | ++ |
| HD-HD-NI | CCC | +++ | | | | HD-HD-NN | TCG | ++ | HD-HD-NG | GCT | ++ |
| HD-HD-NI | CCG | +++ | | | | HD-HD-NN | ACG | +++ | HD-HD-NG | ACT | +++ |
| HD-HD-NI | CTA | +++ | | | | HD-HD-NN | CAG | +++ | HD-HD-NG | CAT | +++ |
| | | | | | | HD-HD-NN | CCA | +++ | HD-HD-NG | CCC | +++ |
| | | | | | | HD-HD-NN | CCC | +++ | HD-HD-NG | CCT | +++ |
| | | | | | | HD-HD-NN | CCG | +++ | | | |

TABLE 2G

List of all tri-base containing pseudo-palindromic sequences targets

| mutant | target | | mutant | target | | mutant | target | | mutant | target | |
|---|---|---|---|---|---|---|---|---|---|---|---|
| HD-NN-NI | AAC | + | HD-NN-HD | ACA | + | HD-NN-NN | AGT | + | HD-NN-NG | ACG | + |
| HD-NN-NI | AGT | + | HD-NN-HD | AGG | + | HD-NN-NN | CCA | + | HD-NN-NG | ACT | + |
| HD-NN-NI | CCA | + | HD-NN-HD | AGT | + | HD-NN-NN | CCG | + | HD-NN-NG | CCA | + |
| HD-NN-NI | GAA | + | HD-NN-HD | ATC | + | HD-NN-NN | CTA | + | HD-NN-NG | CCT | + |
| HD-NN-NI | GGG | + | HD-NN-HD | ATT | + | HD-NN-NN | GAG | + | HD-NN-NG | CTT | + |
| HD-NN-NI | TGA | + | HD-NN-HD | CAT | + | HD-NN-NN | GGA | + | HD-NN-NG | GAT | + |
| HD-NN-NI | AAG | ++ | HD-NN-HD | CCA | + | HD-NN-NN | TGA | + | HD-NN-NG | GGT | + |
| HD-NN-NI | CAC | ++ | HD-NN-HD | CCT | + | HD-NN-NN | TGG | + | HD-NN-NG | TGT | + |
| HD-NN-NI | CGT | ++ | HD-NN-HD | CGG | + | HD-NN-NN | AAC | ++ | HD-NN-NG | AAA | ++ |
| HD-NN-NI | CTA | ++ | HD-NN-HD | GAC | + | HD-NN-NN | AGC | ++ | HD-NN-NG | AAC | ++ |
| HD-NN-NI | CTG | ++ | HD-NN-HD | GCC | + | HD-NN-NN | CAC | ++ | HD-NN-NG | AAG | ++ |
| HD-NN-NI | GGA | ++ | HD-NN-HD | GGC | + | HD-NN-NN | CGT | ++ | HD-NN-NG | ACA | ++ |
| HD-NN-NI | AAA | +++ | HD-NN-HD | TGC | + | HD-NN-NN | CTG | ++ | HD-NN-NG | AGC | ++ |
| HD-NN-NI | AGA | +++ | HD-NN-HD | AAA | ++ | HD-NN-NN | GGG | ++ | HD-NN-NG | AGG | ++ |
| HD-NN-NI | AGC | +++ | HD-NN-HD | ACC | ++ | HD-NN-NN | AAA | +++ | HD-NN-NG | CAA | ++ |
| HD-NN-NI | AGG | +++ | HD-NN-HD | AGA | ++ | HD-NN-NN | AAG | -+++ | HD-NN-NG | CAC | ++ |
| HD-NN-NI | CAA | +++ | HD-NN-HD | CAA | ++ | HD-NN-NN | AGA | +++ | HD-NN-NG | CAG | ++ |
| HD-NN-NI | CAG | +++ | HD-NN-HD | CGA | ++ | HD-NN-NN | AGG | +++ | HD-NN-NG | AAT | +++ |
| HD-NN-NI | CGA | +++ | HD-NN-HD | CGT | ++ | HD-NN-NN | CAA | +++ | HD-NN-NG | AGA | +++ |
| HD-NN-NI | CGC | +++ | HD-NN-HD | CTC | ++ | HD-NN-NN | CAG | +++ | HD-NN-NG | AGT | +++ |

TABLE 2G-continued

List of all tri-base containing pseudo-palindromic sequences targets

| mutant | target | | mutant | target | | mutant | target | | mutant | target | |
|---|---|---|---|---|---|---|---|---|---|---|---|
| HD-NN-NI | CGG | +++ | HD-NN-HD | AAC | +++ | HD-NN-NN | CGA | +++ | HD-NN-NG | CAT | +++ |
| | | | HD-NN-HD | AGC | +++ | HD-NN-NN | CGC | +++ | HD-NN-NG | CGA | +++ |
| | | | HD-NN-HD | CAC | +++ | HD-NN-NN | CGG | +++ | HD-NN-NG | CGC | +++ |
| | | | HD-NN-HD | CCC | +++ | | | | HD-NN-NG | CGG | +++ |
| | | | HD-NN-HD | CGC | +++ | | | | HD-NN-NG | CGT | +++ |

TABLE 2H

List of all tri-base containing pseudo-palindromic sequences targets

| mutant | target | | mutant | target | | mutant | target | | mutant | target | |
|---|---|---|---|---|---|---|---|---|---|---|---|
| HD-NG-NI | AAG | + | HD-NG-HD | AGA | + | HD-NG-NN | AAC | + | HD-NG-NG | AAG | + |
| HD-NG-NI | ATC | + | HD-NG-HD | ATG | + | HD-NG-NN | ACA | + | HD-NG-NG | ACA | + |
| HD-NG-NI | CAC | + | HD-NG-HD | ATI | + | HD-NG-NN | ACG | + | HD-NG-NG | ACC | + |
| HD-NG-NI | CAG | + | HD-NG-HD | CAA | + | HD-NG-NN | ATC | + | HD-NG-NG | ACT | + |
| HD-NG-NI | CCG | + | HD-NG-HD | CCA | + | HD-NG-NN | CCA | + | HD-NG-NG | AGG | + |
| HD-NG-NI | CGG | + | HD-NG-HD | CCT | + | HD-NG-NN | CCC | + | HD-NG-NG | CAG | + |
| HD-NG-NI | GAA | + | HD-NG-HD | CTT | + | HD-NG-NN | TTG | + | HD-NG-NG | CCC | + |
| HD-NG-NI | ACA | ++ | HD-NG-HD | GAC | + | HD-NG-NN | AAA | ++ | HD-NG-NG | CGC | + |
| HD-NG-NI | AGA | ++ | HD-NG-HD | TCC | + | HD-NG-NN | AGA | ++ | HD-NG-NG | CGG | + |
| HD-NG-NI | CAA | ++ | HD-NG-HD | AGC | ++ | HD-NG-NN | AGG | ++ | HD-NG-NG | GAT | + |
| HD-NG-NI | CCA | ++ | HD-NG-HD | CTG | ++ | HD-NG-NN | CAA | ++ | HD-NG-NG | GTT | + |
| HD-NG-NI | CCC | ++ | HD-NG-HD | GTC | ++ | HD-NG-NN | CAC | ++ | HD-NG-NG | AAA | ++ |
| HD-NG-NI | CGA | ++ | HD-NG-HD | TTC | ++ | HD-NG-NN | CAG | ++ | HD-NG-NG | AAC | ++ |
| HD-NG-NI | CTC | ++ | HD-NG-HD | AAA | +++ | HD-NG-NN | CCG | ++ | HD-NG-NG | AGC | ++ |
| HD-NG-NI | GTA | ++ | HD-NG-HD | AAC | +++ | HD-NG-NN | CGA | ++ | HD-NG-NG | AGT | ++ |
| HD-NG-NI | TAT | ++ | HD-NG-HD | ACC | +++ | HD-NG-NN | CGG | ++ | HD-NG-NG | ATG | ++ |
| HD-NG-NI | TCT | ++ | HD-NG-HD | ATA | +++ | HD-NG-NN | CTC | ++ | HD-NG-NG | CAA | ++ |
| HD-NG-NI | AAA | +++ | HD-NG-HD | ATC | +++ | HD-NG-NN | GTG | ++ | HD-NG-NG | CAC | ++ |
| HD-NG-NI | ATA | +++ | HD-NG-HD | CAC | +++ | HD-NG-NN | AAG | +++ | HD-NG-NG | CCA | ++ |
| HD-NG-NI | ATG | +++ | HD-NG-HD | CCC | +++ | HD-NG-NN | ATA | +++ | HD-NG-NG | CGA | ++ |
| HD-NG-NI | CTA | +++ | HD-NG-HD | CGC | +++ | HD-NG-NN | ATG | +++ | HD-NG-NG | CTG | ++ |
| HD-NG-NI | CTG | +++ | HD-NG-HD | CTA | +++ | HD-NG-NN | CTA | +++ | HD-NG-NG | AAT | +++ |
| | | | HD-NG-HD | CTC | +++ | HD-NG-NN | CTG | +++ | HD-NG-NG | AGA | +++ |
| | | | | | | | | | HD-NG-NG | ATA | +++ |
| | | | | | | | | | HD-NG-NG | ATC | +++ |
| | | | | | | | | | HD-NG-NG | ATT | +++ |
| | | | | | | | | | HD-NG-NG | CAT | +++ |
| | | | | | | | | | HD-NG-NG | CCT | +++ |
| | | | | | | | | | HD-NG-NG | CGT | +++ |
| | | | | | | | | | HD-NG-NG | CTA | +++ |
| | | | | | | | | | HD-NG-NG | CTC | +++ |
| | | | | | | | | | HD-NG-NG | CTT | +++ |

TABLE 2I

List of all tri-base containing pseudo-palindromic sequences targets

| mutant | target | | mutant | target | | mutant | target | | mutant | target | |
|---|---|---|---|---|---|---|---|---|---|---|---|
| NN-NI-NI | AAC | + | NN-NI-HD | AAG | + | NN-NI-NN | AAT | + | NN-NI-NG | ACA | + |
| NN-NI-NI | AAG | + | NN-NI-HD | AAT | + | NN-NI-NN | ACA | + | NN-NI-NG | ACC | + |
| NN-NI-NI | ACA | + | NN-NI-HD | ACC | + | NN-NI-NN | ACG | + | NN-NI-NG | AGG | + |
| NN-NI-NI | AGC | + | NN-NI-HD | AGA | + | NN-NI-NN | AGG | + | NN-NI-NG | ATA | + |
| NN-NI-NI | CAA | + | NN-NI-HD | AGC | + | NN-NI-NN | CAA | + | NN-NI-NG | ATC | + |
| NN-NI-NI | CGA | + | NN-NI-HD | AGT | + | NN-NI-NN | CAG | + | NN-NI-NG | CCT | + |
| NN-NI-NI | CGG | + | NN-NI-HD | CAC | + | NN-NI-NN | GCT | + | NN-NI-NG | GTG | + |
| NN-NI-NI | GGT | + | NN-NI-HD | GAG | + | NN-NI-NN | GGC | + | NN-NI-NG | TAA | + |
| NN-NI-NI | TAA | + | NN-NI-HD | GCA | + | NN-NI-NN | GTA | + | NN-NI-NG | TCT | + |
| NN-NI-NI | AGA | ++ | NN-NI-HD | GCT | + | NN-NI-NN | GTG | + | NN-NI-NG | AAA | ++ |
| NN-NI-NI | AGG | ++ | NN-NI-HD | GTC | + | NN-NI-NN | TAA | + | NN-NI-NG | AAC | ++ |
| NN-NI-NI | GAC | ++ | NN-NI-HD | TAC | + | NN-NI-NN | TAG | + | NN-NI-NG | AAG | ++ |
| NN-NI-NI | GAG | ++ | NN-NI-HD | GAA | ++ | NN-NI-NN | AAC | ++ | NN-NI-NG | ACT | ++ |
| NN-NI-NI | GGC | ++ | NN-NI-HD | GAT | ++ | NN-NI-NN | AGA | ++ | NN-NI-NG | AGA | ++ |
| NN-NI-NI | GGG | ++ | NN-NI-HD | GCC | ++ | NN-NI-NN | AGT | ++ | NN-NI-NG | AGC | ++ |
| NN-NI-NI | GTA | ++ | NN-NI-HD | GGA | ++ | NN-NI-NN | GAC | ++ | NN-NI-NG | ATT | ++ |

TABLE 2I-continued

List of all tri-base containing pseudo-palindromic sequences targets

| mutant | target | | mutant | target | | mutant | target | | mutant | target | |
|---|---|---|---|---|---|---|---|---|---|---|---|
| NN-NI-NI | AAA | +++ | NN-NI-HD | GGC | ++ | NN-NI-NN | GAT | ++ | NN-NI-NG | CAA | ++ |
| NN-NI-NI | GAA | +++ | NN-NI-HD | GGT | ++ | NN-NI-NN | GCA | ++ | NN-NI-NG | CAT | ++ |
| NN-NI-NI | GCA | +++ | NN-NI-HD | AAA | +++ | NN-NI-NN | GCG | ++ | NN-NI-NG | CGT | ++ |
| NN-NI-NI | GGA | +++ | NN-NI-HD | AAC | +++ | NN-NI-NN | GGG | ++ | NN-NI-NG | GAG | ++ |
| | | | NN-NI-HD | GAC | +++ | NN-NI-NN | GGT | ++ | NN-NI-NG | GCA | ++ |
| | | | | | | NN-NI-NN | AAA | +++ | NN-NI-NG | GCC | ++ |
| | | | | | | NN-NI-NN | AAG | +++ | NN-NI-NG | GCG | ++ |
| | | | | | | NN-NI-NN | GAA | +++ | NN-NI-NG | GGA | ++ |
| | | | | | | NN-NI-NN | GAG | +++ | NN-NI-NG | GGC | ++ |
| | | | | | | NN-NI-NN | GGA | +++ | NN-NI-NG | GGG | ++ |
| | | | | | | | | | NN-NI-NG | GTA | ++ |
| | | | | | | | | | NN-NI-NG | GTC | ++ |
| | | | | | | | | | NN-NI-NG | GTT | ++ |
| | | | | | | | | | NN-NI-NG | TAT | ++ |
| | | | | | | | | | NN-NI-NG | TGT | ++ |
| | | | | | | | | | NN-NI-NG | AAT | +++ |
| | | | | | | | | | NN-NI-NG | AGT | +++ |
| | | | | | | | | | NN-NI-NG | GAA | +++ |
| | | | | | | | | | NN-NI-NG | GAC | +++ |
| | | | | | | | | | NN-NI-NG | GAT | +++ |
| | | | | | | | | | NN-NI-NG | GCT | +++ |
| | | | | | | | | | NN-NI-NG | GGT | +++ |

TABLE 2J

List of all tri-base containing pseudo-palindromic sequences targets

| mutant | target | | mutant | target | | mutant | target | | mutant | target | |
|---|---|---|---|---|---|---|---|---|---|---|---|
| NN-HD-NI | ACT | + | NN-HD-HD | AAG | + | NN-HD-NN | AGA | + | NN-HD-NG | AGA | + |
| NN-HD-NI | AGC | + | NN-HD-HD | AAT | + | NN-HD-NN | AGG | + | NN-HD-NG | AGC | + |
| NN-HD-NI | ATC | + | NN-HD-HD | ACG | + | NN-HD-NN | ATG | + | NN-HD-NG | ATA | + |
| NN-HD-NI | CCG | + | NN-HD-HD | ACT | + | NN-HD-NN | CAA | + | NN-HD-NG | CAA | + |
| NN-HD-NI | GAG | + | NN-HD-HD | AGA | + | NN-HD-NN | CCC | + | NN-HD-NG | CAC | + |
| NN-HD-NI | GCT | + | NN-HD-HD | ATC | + | NN-HD-NN | GGG | + | NN-HD-NG | CCA | + |
| NN-HD-NI | GGA | + | NN-HD-HD | CCA | + | NN-HD-NN | TCA | + | NN-HD-NG | CCG | + |
| NN-HD-NI | GTC | + | NN-HD-HD | GAA | + | NN-HD-NN | AAC | ++ | NN-HD-NG | CTT | + |
| NN-HD-NI | AAC | ++ | NN-HD-HD | GCG | + | NN-HD-NN | ACT | ++ | NN-HD-NG | GAG | + |
| NN-HD-NI | AAG | ++ | NN-HD-HD | GGC | + | NN-HD-NN | CAG | ++ | NN-HD-NG | GGA | + |
| NN-HD-NI | AGA | ++ | NN-HD-HD | TAC | + | NN-HD-NN | CCA | ++ | NN-HD-NG | GGC | + |
| NN-HD-NI | ATA | ++ | NN-HD-HD | AAA | ++ | NN-HD-NN | GAC | ++ | NN-HD-NG | GGT | + |
| NN-HD-NI | CAA | ++ | NN-HD-HD | AGC | ++ | NN-HD-NN | GCT | ++ | NN-HD-NG | GTA | + |
| NN-HD-NI | CCC | ++ | NN-HD-HD | CAC | ++ | NN-HD-NN | GTG | ++ | NN-HD-NG | GTC | + |
| NN-HD-NI | GAC | ++ | NN-HD-HD | GCT | ++ | NN-HD-NN | TCG | ++ | NN-HD-NG | AAG | ++ |
| NN-HD-NI | GTG | ++ | NN-HD-HD | GTC | ++ | NN-HD-NN | AAA | +++ | NN-HD-NG | ACG | ++ |
| NN-HD-NI | TCA | ++ | NN-HD-HD | TCC | ++ | NN-HD-NN | AAG | +++ | NN-HD-NG | AGT | ++ |
| NN-HD-NI | AAA | +++ | NN-HD-HD | AAC | +++ | NN-HD-NN | ACA | +++ | NN-HD-NG | ATC | ++ |
| NN-HD-NI | ACA | +++ | NN-HD-HD | ACA | +++ | NN-HD-NN | ACC | +++ | NN-HD-NG | ATT | ++ |
| NN-HD-NI | ACC | +++ | NN-HD-HD | ACC | +++ | NN-HD-NN | ACG | +++ | NN-HD-NG | CAT | ++ |
| NN-HD-NI | ACG | +++ | NN-HD-HD | CCC | +++ | NN-HD-NN | CCG | +++ | NN-HD-NG | CCC | ++ |
| NN-HD-NI | CCA | +++ | NN-HD-HD | GAC | +++ | NN-HD-NN | GAA | +++ | NN-HD-NG | GAA | ++ |
| NN-HD-NI | GAA | +++ | NN-HD-HD | GCA | +++ | NN-HD-NN | GAG | +++ | NN-HD-NG | GAC | ++ |
| NN-HD-NI | GCA | +++ | NN-HD-HD | GCC | +++ | NN-HD-NN | GCA | +++ | NN-HD-NG | GCA | ++ |
| NN-HD-NI | GCC | +++ | | | | NN-HD-NN | GCC | +++ | NN-HD-NG | GCG | +++ |
| NN-HD-NI | GCG | +++ | | | | NN-HD-NN | GCG | +++ | NN-HD-NG | GTT | ++ |
| NN-HD-NI | GTA | +++ | | | | | | | NN-HD-NG | TCT | ++ |
| | | | | | | | | | NN-HD-NG | AAA | +++ |
| | | | | | | | | | NN-HD-NG | AAC | +++ |
| | | | | | | | | | NN-HD-NG | AAT | +++ |
| | | | | | | | | | NN-HD-NG | ACA | +++ |
| | | | | | | | | | NN-HD-NG | ACC | +++ |
| | | | | | | | | | NN-HD-NG | ACT | +++ |
| | | | | | | | | | NN-HD-NG | CCT | +++ |
| | | | | | | | | | NN-HD-NG | GAT | +++ |
| | | | | | | | | | NN-HD-NG | GCC | +++ |
| | | | | | | | | | NN-HD-NG | GCT | +++ |

TABLE 2K

List of all tri-base containing pseudo-palindromic sequences targets

| mutant | target |  | mutant | target |  | mutant | target |  | mutant | target |  |
|---|---|---|---|---|---|---|---|---|---|---|---|
| NN-NN-NI | AAC | + | NN-NN-HD | ACA | + | NN-NN-NN | ACA | + | NN-NN-NG | ACA | + |
| NN-NN-NI | ACA | + | NN-NN-HD | AGT | + | NN-NN-NN | ACG | + | NN-NN-NG | ACT | + |
| NN-NN-NI | AGT | + | NN-NN-HD | ATA | + | NN-NN-NN | ATG | + | NN-NN-NG | ATC | + |
| NN-NN-NI | ATA | + | NN-NN-HD | ATC | + | NN-NN-NN | CAA | + | NN-NN-NG | ATT | + |
| NN-NN-NI | CAA | + | NN-NN-HD | CAC | + | NN-NN-NN | CAG | + | NN-NN-NG | CGA | + |
| NN-NN-NI | CGC | + | NN-NN-HD | CCC | + | NN-NN-NN | GAT | + | NN-NN-NG | GTA | + |
| NN-NN-NI | CGG | + | NN-NN-HD | CGA | + | NN-NN-NN | GCG | + | NN-NN-NG | GTT | + |
| NN-NN-NI | TGA | + | NN-NN-HD | GAG | + | NN-NN-NN | GGT | + | NN-NN-NG | AAC | ++ |
| NN-NN-NI | AAG | ++ | NN-NN-HD | GAT | + | NN-NN-NN | GTA | + | NN-NN-NG | AAG | ++ |
| NN-NN-NI | AGC | ++ | NN-NN-HD | GGG | + | NN-NN-NN | TGA | + | NN-NN-NG | AGG | ++ |
| NN-NN-NI | GAC | ++ | NN-NN-HD | GGT | + | NN-NN-NN | TGG | + | NN-NN-NG | ATA | ++ |
| NN-NN-NI | GAG | ++ | NN-NN-HD | GTA | + | NN-NN-NN | AAC | ++ | NN-NN-NG | CGT | ++ |
| NN-NN-NI | GGT | ++ | NN-NN-HD | TAC | + | NN-NN-NN | AGC | ++ | NN-NN-NG | GAC | ++ |
| NN-NN-NI | GTA | ++ | NN-NN-HD | TGC | + | NN-NN-NN | AGT | ++ | NN-NN-NG | GAG | ++ |
| NN-NN-NI | AAA | +++ | NN-NN-HD | ACC | ++ | NN-NN-NN | CGA | ++ | NN-NN-NG | GCA | ++ |
| NN-NN-NI | AGA | +++ | NN-NN-HD | CGC | ++ | NN-NN-NN | CGG | ++ | NN-NN-NG | GCT | ++ |
| NN-NN-NI | AGG | +++ | NN-NN-HD | GCA | ++ | NN-NN-NN | GAC | ++ | NN-NN-NG | GGC | ++ |
| NN-NN-NI | CGA | +++ | NN-NN-HD | GGA | ++ | NN-NN-NN | GCA | ++ | NN-NN-NG | AAA | +++ |
| NN-NN-NI | GAA | +++ | NN-NN-HD | GTC | ++ | NN-NN-NN | GGC | ++ | NN-NN-NG | AAT | +++ |
| NN-NN-NI | GCA | +++ | NN-NN-HD | AAA | +++ | NN-NN-NN | GTG | ++ | NN-NN-NG | AGA | +++ |
| NN-NN-NI | GGA | +++ | NN-NN-HD | AAC | +++ | NN-NN-NN | AAA | +++ | NN-NN-NG | AGC | +++ |
| NN-NN-NI | GGC | +++ | NN-NN-HD | AGA | +++ | NN-NN-NN | AAG | +++ | NN-NN-NG | AGT | +++ |
| NN-NN-NI | GGG | +++ | NN-NN-HD | AGC | +++ | NN-NN-NN | AGA | +++ | NN-NN-NG | GAA | +++ |
|  |  |  | NN-NN-HD | GAA | +++ | NN-NN-NN | AGG | +++ | NN-NN-NG | GAT | +++ |
|  |  |  | NN-NN-HD | GAC | +++ | NN-NN-NN | GAA | +++ | NN-NN-NG | GGA | +++ |
|  |  |  | NN-NN-HD | GCC | +++ | NN-NN-NN | GAG | +++ | NN-NN-NG | GGG | +++ |
|  |  |  | NN-NN-HD | GGC | +++ | NN-NN-NN | GGA | +++ | NN-NN-NG | GGT | +++ |
|  |  |  |  |  |  | NN-NN-NN | GGG | +++ |  |  |  |

TABLE 2L

List of all tri-base containing pseudo-palindromic sequences targets

| mutant | target |  | mutant | target |  | mutant | target |  | mutant | target |  |
|---|---|---|---|---|---|---|---|---|---|---|---|
| NN-NG-NI | ACC | + | NN-NG-HD | AAG | + | NN-NG-NN | AAT | + | NN-NG-NG | ACG | + |
| NN-NG-NI | AGT | + | NN-NG-HD | AAT | + | NN-NG-NN | ACA | + | NN-NG-NG | CAA | + |
| NN-NG-NI | ATT | + | NN-NG-HD | ACA | + | NN-NG-NN | AGC | + | NN-NG-NG | CAC | + |
| NN-NG-NI | CCA | + | NN-NG-HD | AGT | + | NN-NG-NN | AGT | + | NN-NG-NG | CCT | + |
| NN-NG-NI | CGC | + | NN-NG-HD | ATT | + | NN-NG-NN | ATI | + | NN-NG-NG | CGA | + |
| NN-NG-NI | CTC | + | NN-NG-HD | CAA | + | NN-NG-NN | CAG | + | NN-NG-NG | CGC | + |
| NN-NG-NI | CTG | + | NN-NG-HD | CCC | + | NN-NG-NN | CTA | + | NN-NG-NG | CTG | + |
| NN-NG-NI | GGG | + | NN-NG-HD | CTA | + | NN-NG-NN | GAC | + | NN-NG-NG | GCG | + |
| NN-NG-NI | GGT | + | NN-NG-HD | GAG | + | NN-NG-NN | GAT | + | NN-NG-NG | TAT | + |
| NN-NG-NI | TAA | + | NN-NG-HD | GAT | + | NN-NG-NN | GCC | + | NN-NG-NG | TCT | + |
| NN-NG-NI | TGA | + | NN-NG-HD | GCT | + | NN-NG-NN | GGC | + | NN-NG-NG | TGT | + |
| NN-NG-NI | AAC | ++ | NN-NG-HD | GGA | + | NN-NG-NN | TTG | + | NN-NG-NG | TTA | + |
| NN-NG-NI | AAG | ++ | NN-NG-HD | GGT | ++ | NN-NG-NN | AAA | ++ | NN-NG-NG | TTT | + |
| NN-NG-NI | ACA | ++ | NN-NG-HD | TAC | + | NN-NG-NN | AAC | ++ | NN-NG-NG | AAA | ++ |
| NN-NG-NI | AGA | ++ | NN-NG-HD | TTA | + | NN-NG-NN | ACG | ++ | NN-NG-NG | AAC | ++ |
| NN-NG-NI | AGC | ++ | NN-NG-HD | AGA | ++ | NN-NG-NN | AGA | ++ | NN-NG-NG | AAG | ++ |
| NN-NG-NI | AGG | ++ | NN-NG-HD | AGC | ++ | NN-NG-NN | AGG | ++ | NN-NG-NG | ACA | ++ |
| NN-NG-NI | CAA | ++ | NN-NG-HD | ATG | ++ | NN-NG-NN | ATC | ++ | NN-NG-NG | ACC | ++ |
| NN-NG-NI | CGA | ++ | NN-NG-HD | CAC | ++ | NN-NG-NN | CTG | ++ | NN-NG-NG | ACT | ++ |
| NN-NG-NI | CTA | ++ | NN-NG-HD | CGC | ++ | NN-NG-NN | GAA | ++ | NN-NG-NG | AGA | ++ |
| NN-NG-NI | GAC | ++ | NN-NG-HD | GCA | ++ | NN-NG-NN | GCA | ++ | NN-NG-NG | AGC | ++ |
| NN-NG-NI | GAG | ++ | NN-NG-HD | GGC | ++ | NN-NG-NN | GCG | ++ | NN-NG-NG | AGG | ++ |
| NN-NG-NI | GCC | ++ | NN-NG-HD | GTG | ++ | NN-NG-NN | GGA | ++ | NN-NG-NG | CAT | ++ |
| NN-NG-NI | GGA | ++ | NN-NG-HD | GTT | ++ | NN-NG-NN | GGG | ++ | NN-NG-NG | CGT | ++ |
| NN-NG-NI | GGC | ++ | NN-NG-HD | TTC | ++ | NN-NG-NN | GTC | ++ | NN-NG-NG | CTA | ++ |
| NN-NG-NI | GTT | ++ | NN-NG-HD | AAA | +++ | NN-NG-NN | GTT | ++ | NN-NG-NG | CTC | ++ |
| NN-NG-NI | TTA | ++ | NN-NG-HD | AAC | +++ | NN-NG-NN | AAG | +++ | NN-NG-NG | CTT | ++ |
| NN-NG-NI | AAA | +++ | NN-NG-HD | ACC | +++ | NN-NG-NN | ATA | +++ | NN-NG-NG | GAA | ++ |
| NN-NG-NI | ATA | +++ | NN-NG-HD | ATA | +++ | NN-NG-NN | ATG | +++ | NN-NG-NG | GAC | ++ |
| NN-NG-NI | ATC | +++ | NN-NG-HD | ATC | +++ | NN-NG-NN | GAG | +++ | NN-NG-NG | GAG | ++ |
| NN-NG-NI | ATG | +++ | NN-NG-HD | CTC | +++ | NN-NG-NN | GTA | +++ | NN-NG-NG | GCA | ++ |
| NN-NG-NI | GAA | +++ | NN-NG-HD | GAA | +++ | NN-NG-NN | GTG | +++ | NN-NG-NG | GCC | ++ |
| NN-NG-NI | GCA | +++ | NN-NG-HD | GAC | +++ |  |  |  | NN-NG-NG | GCT | ++ |
| NN-NG-NI | GTA | +++ | NN-NG-HD | GCC | +++ |  |  |  | NN-NG-NG | GGA | ++ |
| NN-NG-NI | GTC | +++ | NN-NG-HD | GTA | +++ |  |  |  | NN-NG-NG | GGC | ++ |

TABLE 2L-continued

List of all tri-base containing pseudo-palindromic sequences targets

| mutant | target | | mutant | target | | mutant | target | | mutant | target | |
|---|---|---|---|---|---|---|---|---|---|---|---|
| NN-NG-NI | GTG | +++ | NN-NG-HD | GTC | +++ | | | | NN-NG-NG | GGG | ++ |
| | | | | | | | | | NN-NG-NG | GGT | ++ |
| | | | | | | | | | NN-NG-NG | AAT | +++ |
| | | | | | | | | | NN-NG-NG | AGT | +++ |
| | | | | | | | | | NN-NG-NG | ATA | +++ |
| | | | | | | | | | NN-NG-NG | ATC | +++ |
| | | | | | | | | | NN-NG-NG | ATG | +++ |
| | | | | | | | | | NN-NG-NG | ATT | +++ |
| | | | | | | | | | NN-NG-NG | GAT | +++ |
| | | | | | | | | | NN-NG-NG | GTA | +++ |
| | | | | | | | | | NN-NG-NG | GTC | +++ |
| | | | | | | | | | NN-NG-NG | GTG | +++ |
| | | | | | | | | | NN-NG-NG | GTT | +++ |

TABLE 2M

List of all tri-base containing pseudo-palindromic sequences targets

| mutant | target | | mutant | target | | mutant | target | | mutant | target | |
|---|---|---|---|---|---|---|---|---|---|---|---|
| NG-NI-NI | AGA | + | NG-NI-HD | ACC | + | NG-NI-NN | ACG | + | NG-NI-NG | AAC | + |
| NG-NI-NI | GAA | + | NG-NI-HD | AGA | + | NG-NI-NN | AGG | + | NG-NI-NG | ACT | + |
| NG-NI-NI | GCA | + | NG-NI-HD | AGC | + | NG-NI-NN | AGT | + | NG-NI-NG | AGA | + |
| NG-NI-NI | TCA | + | NG-NI-HD | CAA | + | NG-NI-NN | GCG | + | NG-NI-NG | CAA | + |
| NG-NI-NI | TGC | + | NG-NI-HD | GAA | + | NG-NI-NN | GGG | + | NG-NI-NG | CAC | + |
| NG-NI-NI | AAA | ++ | NG-NI-HD | GCC | + | NG-NI-NN | TCA | + | NG-NI-NG | CCT | + |
| NG-NI-NI | CAA | ++ | NG-NI-HD | TCA | + | NG-NI-NN | TGT | + | NG-NI-NG | CGT | + |
| NG-NI-NI | TAC | ++ | NG-NI-HD | TGA | + | NG-NI-NN | AAC | ++ | NG-NI-NG | GAA | + |
| NG-NI-NI | TAG | ++ | NG-NI-HD | TGT | + | NG-NI-NN | AGA | ++ | NG-NI-NG | GCT | + |
| NG-NI-NI | TGA | ++ | NG-NI-HD | AAA | ++ | NG-NI-NN | CAA | ++ | NG-NI-NG | GGT | + |
| NG-NI-NI | TAA | +++ | NG-NI-HD | GAC | ++ | NG-NI-NN | GAA | ++ | NG-NI-NG | TCA | + |
| | | | NG-NI-HD | TAG | ++ | NG-NI-NN | GAG | ++ | NG-NI-NG | TCC | + |
| | | | NG-NI-HD | TAT | ++ | NG-NI-NN | TCG | ++ | NG-NI-NG | TGC | + |
| | | | NG-NI-HD | TCC | ++ | NG-NI-NN | TGA | ++ | NG-NI-NG | TGG | + |
| | | | NG-NI-HD | TGC | ++ | NG-NI-NN | TGG | ++ | NG-NI-NG | TTT | + |
| | | | NG-NI-HD | AAC | +++ | NG-NI-NN | AAA | +++ | NG-NI-NG | AGT | ++ |
| | | | NG-NI-HD | CAC | +++ | NG-NI-NN | AAG | +++ | NG-NI-NG | GAT | ++ |
| | | | NG-NI-HD | TAA | +++ | NG-NI-NN | CAG | +++ | NG-NI-NG | TAG | ++ |
| | | | NG-NI-HD | TAC | +++ | NG-NI-NN | TAA | +++ | NG-NI-NG | TCT | ++ |
| | | | | | | NG-NI-NN | TAC | +++ | NG-NI-NG | TGA | +++ |
| | | | | | | NG-NI-NN | TAG | +++ | NG-NI-NG | AAA | +++ |
| | | | | | | NG-NI-NN | TAT | +++ | NG-NI-NG | TAT | +++ |
| | | | | | | | | | NG-NI-NG | CAT | +++ |
| | | | | | | | | | NG-NI-NG | TAA | +++ |
| | | | | | | | | | NG-NI-NG | TAC | +++ |
| | | | | | | | | | NG-NI-NG | TAT | +++ |
| | | | | | | | | | NG-NI-NG | TGT | +++ |

TABLE 2N

List of all tri-base containing pseudo-palindromic sequences targets

| mutant | target | | mutant | target | | mutant | target | | mutant | target | |
|---|---|---|---|---|---|---|---|---|---|---|---|
| NG-HD-NI | AAC | + | NG-HD-HD | AAG | + | NG-HD-NN | ACT | + | NG-HD-NG | AAG | + |
| NG-HD-NI | AGA | + | NG-HD-HD | AGC | + | NG-HD-NN | CCT | + | NG-HD-NG | AGT | + |
| NG-HD-NI | CAC | + | NG-HD-HD | TAT | + | NG-HD-NN | CGA | + | NG-HD-NG | ATT | + |
| NG-HD-NI | CAG | + | NG-HD-HD | TTA | + | NG-HD-NN | GAA | + | NG-HD-NG | GAA | + |
| NG-HD-NI | GAA | + | NG-HD-HD | AAA | ++ | NG-HD-NN | GAG | + | NG-HD-NG | GAC | + |
| NG-HD-NI | GCG | + | NG-HD-HD | ACG | ++ | NG-HD-NN | GCC | + | NG-HD-NG | GAT | + |
| NG-HD-NI | GTA | + | NG-HD-HD | ACT | + | NG-HD-NN | TGA | + | NG-HD-NG | GCC | + |
| NG-HD-NI | TCT | + | NG-HD-HD | ATC | ++ | NG-HD-NN | TTA | + | NG-HD-NG | TGC | + |
| NG-HD-NI | TGC | + | NG-HD-HD | CAA | ++ | NG-HD-NN | AAA | ++ | NG-HD-NG | AAC | ++ |
| NG-HD-NI | TGG | + | NG-HD-HD | CCA | ++ | NG-HD-NN | AAC | ++ | NG-HD-NG | ACA | ++ |
| NG-HD-NI | TTC | + | NG-HD-HD | CCG | ++ | NG-HD-NN | ACC | ++ | NG-HD-NG | ACG | ++ |
| NG-HD-NI | TTG | + | NG-HD-HD | CCT | ++ | NG-HD-NN | ATG | ++ | NG-HD-NG | CAA | ++ |
| NG-HD-NI | AAG | ++ | NG-HD-HD | CGC | ++ | NG-HD-NN | CAA | ++ | NG-HD-NG | CAC | ++ |

TABLE 2N-continued

List of all tri-base containing pseudo-palindromic sequences targets

| mutant | target | | mutant | target | | mutant | target | | mutant | target | |
|---|---|---|---|---|---|---|---|---|---|---|---|
| NG-HD-NI | ATA | ++ | NG-HD-HD | CTC | ++ | NG-HD-NN | CAC | ++ | NG-HD-NG | CAT | ++ |
| NG-HD-NI | CAA | ++ | NG-HD-HD | GAC | ++ | NG-HD-NN | CCC | ++ | NG-HD-NG | CCA | ++ |
| NG-HD-NI | CCG | ++ | NG-HD-HD | GCA | ++ | NG-HD-NN | CTG | ++ | NG-HD-NG | CCC | ++ |
| NG-HD-NI | CTA | ++ | NG-HD-HD | GTC | ++ | NG-HD-NN | GCA | ++ | NG-HD-NG | CCG | ++ |
| NG-HD-NI | GCC | ++ | NG-HD-HD | TAG | ++ | NG-HD-NN | GCG | ++ | NG-HD-NG | GCA | ++ |
| NG-HD-NI | TGA | ++ | NG-HD-HD | TCT | ++ | NG-HD-NN | TCT | ++ | NG-HD-NG | GCT | ++ |
| NG-HD-NI | AAA | +++ | NG-HD-HD | AAC | +++ | NG-HD-NN | TGG | ++ | NG-HD-NG | TAG | ++ |
| NG-HD-NI | ACA | +++ | NG-HD-HD | ACA | +++ | NG-HD-NN | TTG | ++ | NG-HD-NG | TCG | ++ |
| NG-HD-NI | ACC | +++ | NG-HD-HD | ACC | +++ | NG-HD-NN | AAG | +++ | NG-HD-NG | TGT | ++ |
| NG-HD-NI | ACG | +++ | NG-HD-HD | CAC | +++ | NG-HD-NN | ACA | +++ | NG-HD-NG | TTA | ++ |
| NG-HD-NI | CCA | +++ | NG-HD-HD | CCC | +++ | NG-HD-NN | ACG | +++ | NG-HD-NG | TTC | ++ |
| NG-HD-NI | CCC | +++ | NG-HD-HD | GCC | +++ | NG-HD-NN | CAG | +++ | NG-HD-NG | TTT | ++ |
| NG-HD-NI | GCA | +++ | NG-HD-HD | TAA | +++ | NG-HD-NN | CCA | +++ | NG-HD-NG | AAA | +++ |
| NG-HD-NI | TAA | +++ | NG-HD-HD | TAC | +++ | NG-HD-NN | CCG | +++ | NG-HD-NG | AAT | +++ |
| NG-HD-NI | TAC | +++ | NG-HD-HD | TCA | +++ | NG-HD-NN | TAA | +++ | NG-HD-NG | ACC | +++ |
| NG-HD-NI | TAG | +++ | NG-HD-HD | TCC | +++ | NG-HD-NN | TAC | +++ | NG-HD-NG | ACT | +++ |
| NG-HD-NI | TCA | +++ | NG-HD-HD | TCG | +++ | NG-HD-NN | TAG | +++ | NG-HD-NG | CCT | +++ |
| NG-HD-NI | TCC | +++ | NG-HD-HD | TGC | +++ | NG-HD-NN | TCA | +++ | NG-HD-NG | TAA | +++ |
| NG-HD-NI | TCG | +++ | NG-HD-HD | TTC | +++ | NG-HD-NN | TCC | +++ | NG-HD-NG | TAC | +++ |
| NG-HD-NI | TTA | +++ | | | | NG-HD-NN | TCG | +++ | NG-HD-NG | TAT | +++ |
| | | | | | | | | | NG-HD-NG | TCA | +++ |
| | | | | | | | | | NG-HD-NG | TCC | +++ |
| | | | | | | | | | NG-HD-NG | TCT | +++ |

TABLE 2O

List of all tri-base containing pseudo-palindromic sequences targets

| mutant | target | | mutant | target | | mutant | target | | mutant | target | |
|---|---|---|---|---|---|---|---|---|---|---|---|
| NG-NN-NI | AGC | + | NG-NN-HD | ATC | + | NG-NN-NN | ACG | + | NG-NN-NG | ACA | + |
| NG-NN-NI | CCA | + | NG-NN-HD | GAA | + | NG-NN-NN | AGT | + | NG-NN-NG | ACC | + |
| NG-NN-NI | CGC | + | NG-NN-HD | GCC | + | NG-NN-NN | CCG | + | NG-NN-NG | ACT | + |
| NG-NN-NI | GCA | + | NG-NN-HD | GGA | + | NG-NN-NN | CGC | + | NG-NN-NG | ATA | + |
| NG-NN-NI | GGC | + | NG-NN-HD | GTC | + | NG-NN-NN | GGC | + | NG-NN-NG | ATT | + |
| NG-NN-NI | GGG | + | NG-NN-HD | TCA | + | NG-NN-NN | TAT | + | NG-NN-NG | CAG | + |
| NG-NN-NI | TGT | + | NG-NN-HD | TGG | + | NG-NN-NN | TTG | + | NG-NN-NG | CCA | + |
| NG-NN-NI | AAG | ++ | NG-NN-HD | TGT | + | NG-NN-NN | AAC | ++ | NG-NN-NG | CCT | + |
| NG-NN-NI | ACA | ++ | NG-NN-HD | ACC | ++ | NG-NN-NN | AGC | ++ | NG-NN-NG | CGG | + |
| NG-NN-NI | AGG | ++ | NG-NN-HD | AGA | ++ | NG-NN-NN | CAC | ++ | NG-NN-NG | CTT | + |
| NG-NN-NI | CAG | ++ | NG-NN-HD | CAA | ++ | NG-NN-NN | GAA | ++ | NG-NN-NG | GAC | + |
| NG-NN-NI | CGG | ++ | NG-NN-HD | CCC | ++ | NG-NN-NN | GGA | ++ | NG-NN-NG | GAG | + |
| NG-NN-NI | GAA | ++ | NG-NN-HD | CGA | ++ | NG-NN-NN | TCA | ++ | NG-NN-NG | GCT | + |
| NG-NN-NI | TAC | ++ | NG-NN-HD | GAC | ++ | NG-NN-NN | TCG | ++ | NG-NN-NG | GGG | + |
| NG-NN-NI | TCA | ++ | NG-NN-HD | GGC | ++ | NG-NN-NN | TGT | ++ | NG-NN-NG | GTA | + |
| NG-NN-NI | AAA | +++ | NG-NN-HD | TTA | ++ | NG-NN-NN | AAA | +++ | NG-NN-NG | GTT | + |
| NG-NN-NI | AGA | +++ | NG-NN-HD | TTC | ++ | NG-NN-NN | AAG | +++ | NG-NN-NG | TCC | + |
| NG-NN-NI | CAA | +++ | NG-NN-HD | AAA | +++ | NG-NN-NN | AGA | +++ | NG-NN-NG | TTC | + |
| NG-NN-NI | CGA | +++ | NG-NN-HD | AAC | +++ | NG-NN-NN | AGG | +++ | NG-NN-NG | TTG | + |
| NG-NN-NI | GGA | +++ | NG-NN-HD | AGC | +++ | NG-NN-NN | CAA | +++ | NG-NN-NG | AAC | ++ |
| NG-NN-NI | TAA | +++ | NG-NN-HD | CAC | +++ | NG-NN-NN | CAG | +++ | NG-NN-NG | AAG | ++ |
| NG-NN-NI | TAG | +++ | NG-NN-HD | CGC | +++ | NG-NN-NN | CGA | +++ | NG-NN-NG | AGC | ++ |
| NG-NN-NI | TGA | +++ | NG-NN-HD | TAA | +++ | NG-NN-NN | CGG | +++ | NG-NN-NG | AGG | ++ |
| NG-NN-NI | TGC | +++ | NG-NN-HD | TAC | +++ | NG-NN-NN | GAG | +++ | NG-NN-NG | CAA | ++ |
| NG-NN-NI | TGG | +++ | NG-NN-HD | TCC | +++ | NG-NN-NN | GGG | +++ | NG-NN-NG | CGC | ++ |
| | | | NG-NN-HD | TGA | +++ | NG-NN-NN | TAA | +++ | NG-NN-NG | GAA | ++ |
| | | | NG-NN-HD | TGC | +++ | NG-NN-NN | TAC | +++ | NG-NN-NG | GAT | ++ |
| | | | | | | NG-NN-NN | TAG | +++ | NG-NN-NG | GCA | ++ |
| | | | | | | NG-NN-NN | TGA | +++ | NG-NN-NG | GGA | ++ |
| | | | | | | NG-NN-NN | TGC | +++ | NG-NN-NG | GGC | ++ |
| | | | | | | NG-NN-NN | TGG | +++ | NG-NN-NG | TCA | ++ |
| | | | | | | | | | NG-NN-NG | TCT | ++ |
| | | | | | | | | | NG-NN-NG | TTA | ++ |
| | | | | | | | | | NG-NN-NG | TTT | ++ |
| | | | | | | | | | NG-NN-NG | AAA | +++ |
| | | | | | | | | | NG-NN-NG | AAT | +++ |
| | | | | | | | | | NG-NN-NG | AGA | +++ |
| | | | | | | | | | NG-NN-NG | AGT | +++ |
| | | | | | | | | | NG-NN-NG | CAC | +++ |
| | | | | | | | | | NG-NN-NG | CAT | +++ |
| | | | | | | | | | NG-NN-NG | CGA | +++ |
| | | | | | | | | | NG-NN-NG | CGT | +++ |
| | | | | | | | | | NG-NN-NG | GGT | +++ |

TABLE 2O-continued

List of all tri-base containing pseudo-palindromic sequences targets

| mutant | target | mutant | target | mutant | target | mutant | target |
|---|---|---|---|---|---|---|---|
| | | | | | | NG-NN-NG | TAA +++ |
| | | | | | | NG-NN-NG | TAC +++ |
| | | | | | | NG-NN-NG | TAG +++ |
| | | | | | | NG-NN-NG | TAT +++ |
| | | | | | | NG-NN-NG | TGA +++ |
| | | | | | | NG-NN-NG | TGC +++ |
| | | | | | | NG-NN-NG | TGG +++ |
| | | | | | | NG-NN-NG | TGT +++ |

TABLE 2P

List of all tri-base containing pseudo-palindromic sequences targets

| mutant | target | mutant | target | mutant | target | mutant | target |
|---|---|---|---|---|---|---|---|
| NG-NG-NI | AAG + | NG-NG-HD | AAA + | NG-NG-NN | AAA + | NG-NG-NG | AAC + |
| NG-NG-NI | AGC + | NG-NG-HD | ACA + | NG-NG-NN | ACA + | NG-NG-NG | ACA + |
| NG-NG-NI | ATC + | NG-NG-HD | AGA + | NG-NG-NN | ACG + | NG-NG-NG | ACC + |
| NG-NG-NI | CTC + | NG-NG-HD | ATT + | NG-NG-NN | AGG + | NG-NG-NG | AGC + |
| NG-NG-NI | GGA + | NG-NG-HD | CAA + | NG-NG-NN | ATC + | NG-NG-NG | CAA + |
| NG-NG-NI | GTC + | NG-NG-HD | CCA + | NG-NG-NN | CAA + | NG-NG-NG | CAC + |
| NG-NG-NI | TCC + | NG-NG-HD | GAA + | NG-NG-NN | CAG + | NG-NG-NG | CCC + |
| NG-NG-NI | TGC + | NG-NG-HD | GCA + | NG-NG-NN | CCA + | NG-NG-NG | CCT + |
| NG-NG-NI | TTC + | NG-NG-HD | GTT + | NG-NG-NN | CCG + | NG-NG-NG | CGC + |
| NG-NG-NI | ACA ++ | NG-NG-HD | TAT + | NG-NG-NN | CGA + | NG-NG-NG | CGT + |
| NG-NG-NI | ATG ++ | NG-NG-HD | TGA + | NG-NG-NN | CGG + | NG-NG-NG | GAA + |
| NG-NG-NI | CAA ++ | NG-NG-HD | TGT + | NG-NG-NN | GAA + | NG-NG-NG | GAT + |
| NG-NG-NI | CCA ++ | NG-NG-HD | TTG + | NG-NG-NN | GAG + | NG-NG-NG | GCT + |
| NG-NG-NI | CGA ++ | NG-NG-HD | TTT + | NG-NG-NN | GCA + | NG-NG-NG | GGA + |
| NG-NG-NI | CTG ++ | NG-NG-HD | ACC ++ | NG-NG-NN | GGA + | NG-NG-NG | GGT + |
| NG-NG-NI | GAA ++ | NG-NG-HD | AGC ++ | NG-NG-NN | GGG + | NG-NG-NG | TCG + |
| NG-NG-NI | GCA ++ | NG-NG-HD | CCC ++ | NG-NG-NN | TAC + | NG-NG-NG | TGC + |
| NG-NG-NI | GTG ++ | NG-NG-HD | CGC ++ | NG-NG-NN | TCC + | NG-NG-NG | TGG + |
| NG-NG-NI | TAC ++ | NG-NG-HD | CTA ++ | NG-NG-NN | TGC + | NG-NG-NG | ACT ++ |
| NG-NG-NI | TAG ++ | NG-NG-HD | GAC ++ | NG-NG-NN | TGG + | NG-NG-NG | AGA ++ |
| NG-NG-NI | TTG ++ | NG-NG-HD | GCC ++ | NG-NG-NN | TTT + | NG-NG-NG | AGT ++ |
| NG-NG-NI | AAA +++ | NG-NG-HD | GGC ++ | NG-NG-NN | AAG ++ | NG-NG-NG | ATC ++ |
| NG-NG-NI | AGA +++ | NG-NG-HD | GTA ++ | NG-NG-NN | AGA ++ | NG-NG-NG | CAT ++ |
| NG-NG-NI | ATA +++ | NG-NG-HD | TAA ++ | NG-NG-NN | TCG ++ | NG-NG-NG | CTC ++ |
| NG-NG-NI | CTA +++ | NG-NG-HD | TCA ++ | NG-NG-NN | TGA ++ | NG-NG-NG | CTG ++ |
| NG-NG-NI | GTA +++ | NG-NG-HD | AAC +++ | NG-NG-NN | TTC ++ | NG-NG-NG | GTA ++ |
| NG-NG-NI | TAA +++ | NG-NG-HD | ATA +++ | NG-NG-NN | ATA +++ | NG-NG-NG | GTC ++ |
| NG-NG-NI | TCA +++ | NG-NG-HD | ATC +++ | NG-NG-NN | ATG +++ | NG-NG-NG | GTG ++ |
| NG-NG-NI | TGA +++ | NG-NG-HD | CAC +++ | NG-NG-NN | CTA +++ | NG-NG-NG | TAC ++ |
| NG-NG-NI | TTA +++ | NG-NG-HD | CTC +++ | NG-NG-NN | CTG +++ | NG-NG-NG | TAG ++ |
| | | NG-NG-HD | GTC +++ | NG-NG-NN | GTA +++ | NG-NG-NG | TCA ++ |
| | | NG-NG-HD | TAC +++ | NG-NG-NN | GTG +++ | NG-NG-NG | TCC ++ |
| | | NG-NG-HD | TCC +++ | NG-NG-NN | TAA +++ | NG-NG-NG | TGA ++ |
| | | NG-NG-HD | TGC +++ | NG-NG-NN | TAG +++ | NG-NG-NG | AAA +++ |
| | | NG-NG-HD | TTA +++ | NG-NG-NN | TCA +++ | NG-NG-NG | AAT +++ |
| | | NG-NG-HD | TTC +++ | NG-NG-NN | TTA +++ | NG-NG-NG | ATA +++ |
| | | | | NG-NG-NN | TTG +++ | NG-NG-NG | ATG +++ |
| | | | | | | NG-NG-NG | ATT +++ |
| | | | | | | NG-NG-NG | CTA +++ |
| | | | | | | NG-NG-NG | CTT +++ |
| | | | | | | NG-NG-NG | GTT +++ |
| | | | | | | NG-NG-NG | TAA +++ |
| | | | | | | NG-NG-NG | TAT +++ |
| | | | | | | NG-NG-NG | TCT +++ |
| | | | | | | NG-NG-NG | TGT +++ |
| | | | | | | NG-NG-NG | TTA +++ |
| | | | | | | NG-NG-NG | TTC +++ |
| | | | | | | NG-NG-NG | TTG +++ |
| | | | | | | NG-NG-NG | TTT +++ |

TABLE 3

Correspondence between RVD triplets and target triplets

| Tri-RVD mutant | Target nucleic acid base triplets |
|---|---|
| 1 RVD non responding to the standard code | |
| NI-HD-NI | ATA |
| NI-HD-NI | ATG |
| NI-HD-NI | GCA |
| NI-HD-NI | GTA |
| NI-HD-NN | ACC |
| NI-HD-NN | GCG |
| NI-HD-NG | AAA |
| NI-HD-NG | ACA |
| NI-HD-NG | ATC |
| NI-HD-NG | ATT |
| NI-NN-NI | AGG |
| NI-NN-NI | GAA |
| NI-NN-HD | ATC |
| NI-NN-HD | GGC |
| NI-NN-NN | AGC |
| NI-NN-NN | ATG |
| NI-NN-NN | GAG |
| NI-NN-NN | GGG |
| NI-NN-NG | AAA |
| NI-NN-NG | AGA |
| NI-NN-NG | AGG |
| NI-NN-NG | GGT |
| NI-NG-NI | ATG |
| NI-NG-NI | GTA |
| NI-NG-HD | AAC |
| NI-NG-HD | AGC |
| NI-NG-HD | GAC |
| NI-NG-HD | GTA |
| NI-NG-HD | GTC |
| NI-NG-NN | AAG |
| NI-NG-NN | AGG |
| NI-NG-NN | ATC |
| NI-NG-NN | GTA |
| NI-NG-NN | GTG |
| NI-NG-NG | AAT |
| NI-NG-NG | ATA |
| NI-NG-NG | ATG |
| NI-NG-NG | GTT |
| HD-HD-NI | ATA |
| HD-HD-NI | CTA |
| HD-HD-NI | GCA |
| HD-NN-NI | AAG |
| HD-NN-NI | AGG |
| HD-NN-NI | CGG |
| HD-NN-NN | CTG |
| HD-NN-NG | AGA |
| HD-NN-NG | AGG |
| HD-NN-NG | CAA |
| HD-NN-NG | CGA |
| HD-NN-NG | CGG |
| HD-NG-NI | ATG |
| HD-NG-NI | CAA |
| HD-NG-NI | CGA |
| HD-NG-NI | CTG |
| HD-NG-HD | AAC |
| HD-NG-HD | AGC |
| HD-NG-HD | CAC |
| HD-NG-HD | GTC |
| HD-NG-NN | AAG |
| HD-NG-NN | AGG |
| HD-NG-NN | CGG |
| HD-NG-NG | AGT |
| HD-NG-NG | ATA |
| HD-NG-NG | ATG |
| HD-NG-NG | CAT |
| HD-NG-NG | CGT |
| HD-NG-NG | CTA |
| HD-NG-NG | CTG |
| NN-NI-NI | AGA |
| NN-NI-NI | GGA |
| NN-NI-HD | AGC |
| NN-NI-HD | CAC |
| NN-NI-HD | GAT |
| NN-NI-HD | GGC |
| NN-NI-NN | GGA |
| NN-NI-NG | AGT |
| NN-NI-NG | CAT |
| NN-NI-NG | GAA |
| NN-NI-NG | GAG |
| NN-NI-NG | GGT |
| NN-HD-NI | AAG |
| NN-HD-NI | ACG |
| NN-HD-NI | ATA |
| NN-HD-NI | CCA |
| NN-HD-NI | GCG |
| NN-HD-NI | GGA |
| NN-HD-NI | GTA |
| NN-HD-HD | CCC |
| NN-HD-NN | AAC |
| NN-HD-NN | ACC |
| NN-HD-NN | CCA |
| NN-HD-NN | CCG |
| NN-NN-NI | AAG |
| NN-NN-NI | AGG |
| NN-NN-NI | GAG |
| NN-NN-NI | GGG |
| NN-NN-HD | ACC |
| NN-NN-HD | GCC |
| NN-NN-HD | GTC |
| NN-NN-NN | AGC |
| NN-NN-NN | GGC |
| NN-NN-NG | AGA |
| NN-NN-NG | AGG |
| NN-NN-NG | GAA |
| NN-NN-NG | GAG |
| NN-NN-NG | GCT |
| NN-NN-NG | GGA |
| NN-NN-NG | GGG |
| NN-NG-NI | AAA |
| NN-NG-NI | AGA |
| NN-NG-NI | ATG |
| NN-NG-NI | CTA |
| NN-NG-NI | GAA |
| NN-NG-NI | GTG |
| NN-NG-HD | AAC |
| NN-NG-HD | AGC |
| NN-NG-HD | CTC |
| NN-NG-HD | GAC |
| NN-NG-NN | AAG |
| NN-NG-NN | AGG |
| NN-NG-NN | CTG |
| NN-NG-NN | GAA |
| NN-NG-NN | GAG |
| NN-NG-NN | GGG |
| NN-NG-NN | GTC |
| NN-NG-NG | ATA |
| NN-NG-NG | ATG |
| NN-NG-NG | GAT |
| NN-NG-NG | GGT |
| NN-NG-NG | GTA |
| NN-NG-NG | GTG |
| NG-NI-NI | AAA |
| NG-NI-NI | GAA |
| NG-NI-NI | TGA |
| NG-NI-HD | AAC |
| NG-NI-HD | GAC |
| NG-NI-HD | TGC |
| NG-NI-NN | AAG |
| NG-NI-NN | GAG |
| NG-NI-NN | TGA |
| NG-NI-NG | AAT |
| NG-NI-NG | AGT |
| NG-NI-NG | GAT |
| NG-NI-NG | TAA |
| NG-NI-NG | TAG |
| NG-NI-NG | TGT |
| NG-HD-NI | ACA |
| NG-HD-NI | ATA |

TABLE 3-continued

Correspondence between RVD triplets and target triplets

| Tri-RVD mutant | Target nucleic acid base triplets |
|---|---|
| NG-HD-NI | CTA |
| NG-HD-NI | GCA |
| NG-HD-NI | TCG |
| NG-HD-NI | TTA |
| NG-HD-HD | ACC |
| NG-HD-HD | GCC |
| NG-HD-NN | AAG |
| NG-HD-NN | ACA |
| NG-HD-NN | ACG |
| NG-HD-NN | GCA |
| NG-HD-NN | GCG |
| NG-HD-NN | TCC |
| NG-NN-NI | AGA |
| NG-NN-NI | GAA |
| NG-NN-NI | GGA |
| NG-NN-NI | TGG |
| NG-NN-HD | AAC |
| NG-NN-HD | ACC |
| NG-NN-HD | AGC |
| NG-NN-HD | CCC |
| NG-NN-HD | GAC |
| NG-NN-HD | GCC |
| NG-NN-HD | GGC |
| NG-NN-HD | TCC |
| NG-NN-NN | AAG |
| NG-NN-NN | AGA |
| NG-NN-NN | AGG |
| NG-NN-NN | GAG |
| NG-NN-NN | GGA |
| NG-NN-NN | GGG |

TABLE 3-continued

Correspondence between RVD triplets and target triplets

| Tri-RVD mutant | Target nucleic acid base triplets |
|---|---|
| NG-NN-NN | TGC |
| NG-NN-NG | AGT |
| NG-NN-NG | GGT |
| NG-NN-NG | TAA |
| NG-NN-NG | TAG |
| NG-NN-NG | TGA |
| NG-NN-NG | TGG |
| NG-NG-HD | ACC |
| NG-NG-HD | ATA |
| NG-NG-HD | ATC |
| NG-NG-HD | GTC |
| NG-NG-HD | TAC |
| NG-NG-HD | TGC |
| NG-NG-NN | ATA |
| NG-NG-NN | ATG |
| NG-NG-NN | GTA |
| NG-NG-NN | GTG |
| NG-NG-NN | TAG |
| NG-NG-NN | TGG |
| 2 RVDs non responding to the code | |
| NI-HD-NI | ATG |
| NI-HD-NI | GTA |
| NI-NG-HD | GAC |
| NG-NI-NG | AGT |
| NG-HD-NI | ATA |
| NG-NN-HD | ACC |
| NG-NN-HD | GCC |

TABLE 4

Targeting activity of 1/2/3 RVD triplets

| target | mutant | | target | mutant | | target | mutant | | target | mutant | |
|---|---|---|---|---|---|---|---|---|---|---|---|
| AAA | NI-NI-NI | + | AAC | NI-NG-NG | + | AAT | NI-NG-NG | + | CAA | NI-HD-HD | + |
| AAA | NI-NN-HD | + | AAC | HD-NN-NG | + | AAT | NI-NI-NG | ++ | CAA | HD-NI-NI | + |
| AAA | NI-NG-NI | + | AAC | NN-NG-NG | + | AAT | NI-HD-NG | ++ | CAA | HD-NI-NN | + |
| AAA | NI-NG-NG | + | AAC | NI-NI-HD | ++ | AAT | NI-NN-NG | ++ | CAA | HD-NN-NN | + |
| AAA | NN-NI-HD | + | AAC | NI-HD-HD | ++ | AAT | NI-NN-NN | ++ | CAA | HD-NG-NI | + |
| AAA | NN-HD-HD | + | AAC | NI-NN-HD | ++ | AAT | HD-NI-NG | ++ | CAA | NN-NI-NI | + |
| AAA | NN-NG-HD | + | AAC | NI-NN-NG | ++ | AAT | HD-NG-NG | ++ | CAA | NN-NN-NI | + |
| AAA | NG-NG-NN | + | AAC | NI-NG-HD | ++ | AAT | NN-NI-NI | ++ | CAA | NG-NI-NG | + |
| AAA | NI-NI-NN | ++ | AAC | HD-NI-HD | ++ | AAT | NN-NG-NG | ++ | CAA | NG-NI-NN | + |
| AAA | NI-HD-NN | ++ | AAC | HD-NN-HD | ++ | AAT | NG-NI-NG | ++ | CAA | NG-NN-HD | + |
| AAA | NI-HD-NG | ++ | AAC | HD-NG-HD | ++ | AAT | NG-HD-NG | ++ | CAA | HD-NN-NI | ++ |
| AAA | NI-NN-NG | ++ | AAC | HD-NG-NG | ++ | AAT | NG-NN-NN | ++ | CAA | HD-NN-NN | ++ |
| AAA | NI-NG-NN | ++ | AAC | NN-NI-HD | ++ | AAT | NG-NG-NG | ++ | CAA | HD-NG-NG | ++ |
| AAA | HD-NN-NI | ++ | AAC | NN-NI-NG | ++ | AAT | NN-NI-NG | ++ | CAA | NG-HD-NI | ++ |
| AAA | HD-NN-HD | ++ | AAC | NN-HD-HD | ++ | AAT | NN-HD-NG | +++ | CAA | NG-HD-NN | ++ |
| AAA | HD-NN-NN | ++ | AAC | NN-HD-NN | ++ | ACA | NI-NN-NG | + | CAA | NG-HD-NG | ++ |
| AAA | HD-NN-NG | ++ | AAC | NN-HD-NG | + | ACA | HD-HD-NG | + | CAA | NG-NN-NI | ++ |
| AAA | HD-NG-NN | ++ | AAC | NN-NN-NG | + | ACA | HD-NG-NN | + | CAA | NG-NN-NN | ++ |
| AAA | HD-NG-NG | ++ | AAC | NN-NG-HD | + | ACA | HD-NG-NG | + | CAA | NG-NN-NG | ++ |
| AAA | NN-NI-NI | ++ | AAC | NG-NI-HD | ++ | ACA | HD-NG-NG | + | CAG | HD-NG-HD | + |
| AAA | NN-NI-NN | ++ | AAC | NG-NG-HD | ++ | ACA | NN-NN-NG | + | CAG | NN-NI-HD | + |
| AAA | NN-NI-NG | ++ | AAC | NN-NN-HD | +++ | ACA | NG-HD-HD | + | CAG | NN-NN-HD | + |
| AAA | NN-NN-HD | ++ | AAC | NG-NN-HD | +++ | ACA | NG-NN-NG | + | CAC | NG-NI-HD | + |
| AAA | NN-NN-NN | ++ | AAG | NI-NI-NN | ++ | ACA | NG-NG-NN | + | CAC | HD-NN-HD | ++ |
| AAA | NN-NG-NI | ++ | AAG | NI-HD-NN | ++ | ACA | NI-HD-HD | ++ | CAC | NN-NN-HD | ++ |
| AAA | NN-NG-NN | ++ | AAG | NI-NN-NN | ++ | ACA | HD-HD-NI | ++ | CAC | HD-NI-HD | ++ |
| AAA | NN-NG-NG | ++ | AAG | NI-NG-NN | ++ | ACA | HD-HD-NN | ++ | CAG | HD-HD-NN | + |
| AAA | NG-NI-NI | ++ | AAG | HD-NI-NN | ++ | ACA | HD-NN-NG | ++ | CAG | HD-NI-NN | ++ |
| AAA | NG-HD-NI | ++ | AAG | HD-HD-NN | ++ | ACA | NN-HD-HD | ++ | CAG | HD-NN-NI | ++ |
| AAA | NG-HD-NN | ++ | AAG | HD-NN-NI | ++ | ACA | HD-NN-NN | ++ | CAG | NG-HD-NN | ++ |
| AAA | NG-NN-NN | ++ | AAG | HD-NN-NN | ++ | ACA | NG-NN-NN | ++ | CAG | NG-NN-NN | ++ |
| AAA | NG-NG-NI | ++ | AAG | HD-NN-NG | ++ | ACA | NG-NG-NI | ++ | CAT | NI-NI-NG | + |
| AAA | NI-HD-NI | +++ | AAG | HD-NG-NN | ++ | ACA | NI-HD-NI | ++ | CAT | NI-HD-NI | + |
| AAA | NI-NN-NI | +++ | AAG | NN-NI-NN | ++ | ACA | NI-HD-NN | ++ | CAT | HD-NG-NG | + |
| AAA | NI-NN-NG | +++ | AAG | NN-HD-NI | ++ | ACA | NI-HD-NG | ++ | CAT | NG-HD-NG | + |
| AAA | HD-NG-NI | +++ | AAG | NN-HD-NG | ++ | ACA | NI-HD-NG | ++ | CAT | HD-NI-NG | ++ |

TABLE 4-continued

Targeting activity of 1/2/3 RVD triplets

| target | mutant | | target | mutant | | target | mutant | | target | mutant | |
|---|---|---|---|---|---|---|---|---|---|---|---|
| AAA | HD-NG-HD | +++ | AAG | NN-NN-NI | ++ | ACA | NN-HD-NI | +++ | CAT | HD-NN-NG | ++ |
| AAA | NN-HD-NI | +++ | AAG | NN-NN-NN | ++ | ACA | NN-HD-NG | +++ | CAT | NN-NI-NN | ++ |
| AAA | NN-HD-NN | +++ | AAG | NN-NN-NG | ++ | ACA | NN-HD-NG | +++ | CAT | NG-NI-NG | ++ |
| AAA | NN-HD-NG | +++ | AAG | NN-NG-NI | ++ | ACA | NG-HD-NN | +++ | CAT | NG-NN-NG | ++ |
| AAA | NN-NN-NI | +++ | AAG | NG-HD-NN | ++ | | | | | | |
| AAA | NN-NN-NG | +++ | AAG | NG-NN-NN | ++ | | | | | | |
| AAA | NG-NI-NN | +++ | AAG | NG-NN-NG | ++ | | | | | | |
| AAA | NG-NI-NG | +++ | AAG | NG-NG-NN | ++ | | | | | | |
| AAA | NG-HD-NG | +++ | AAG | NN-HD-NN | +++ | | | | | | |
| AAA | NG-NN-NI | +++ | AAG | NG-NI-NN | +++ | | | | | | |
| AAA | NG-NN-HD | +++ | | | | | | | | | |
| AAA | NG-NN-NG | +++ | | | | | | | | | |
| AAA | NG-NG-NG | +++ | | | | | | | | | |

TABLE 5

Alternative triplets for RVD positions 1/2/3

| target | mutant | target | mutant | target | mutant | target | mutant |
|---|---|---|---|---|---|---|---|
| AAA | NI-NN-HD | AAC | NI-NG-NG | AAT | NI-NG-NG | CAA | NI-HD-HD |
| AAA | NI-NG-NI | AAC | HD-NN-NG | AAT | NI-HD-NG | CAA | HD-NI-NN |
| AAA | NI-NG-NG | AAC | NN-NG-NG | AAT | NI-NN-NG | CAA | HD-NN-NG |
| AAA | NN-NI-HD | AAC | NI-HD-HD | AAT | HD-NI-NG | CAA | HD-NG-NI |
| AAA | NN-HD-HD | AAC | NI-NN-HD | AAT | HD-NN-NG | CAA | NN-NI-NI |
| AAA | NN-NG-HD | AAC | NI-NN-NG | AAT | HD-NG-NG | CAA | NN-NN-NI |
| AAA | NG-NG-NN | AAC | NI-NG-HD | AAT | NN-NN-NG | CAA | NG-NI-NI |
| AAA | NI-NI-NN | AAC | HD-NI-HD | AAT | NN-NG-NG | CAA | NG-NI-NN |
| AAA | NI-HD-NN | AAC | HD-NN-HD | AAT | NG-NI-NG | CAA | NG-NN-HD |
| AAA | NI-HD-NG | AAC | HD-NG-HD | AAT | NG-HD-NG | CAA | HD-NN-NI |
| AAA | NI-NN-NN | AAC | HD-NG-NG | AAT | NG-NN-NG | CAA | HD-NN-NN |
| AAA | NI-NG-NN | AAC | NN-NI-HD | AAT | NG-NG-NG | CAA | HD-NG-NG |
| AAA | HD-NN-NI | AAC | NN-NI-NG | AAT | NN-NI-NG | CAA | NG-HD-NI |
| AAA | HD-NN-HD | AAC | NN-HD-HD | AAT | NN-HD-NG | CAA | NG-HD-NN |
| AAA | HD-NN-NN | AAC | NN-HD-NN | ACA | NI-NN-NG | CAA | NG-HD-NG |
| AAA | HD-NN-NG | AAC | NN-HD-NG | ACA | HD-HD-NG | CAA | NG-NN-NI |
| AAA | HD-NG-NN | AAC | NN-NN-NG | ACA | HD-NG-NN | CAA | NG-NN-HD |
| AAA | HD-NG-NG | AAC | NN-NG-HD | ACA | HD-NG-NG | CAA | NG-NN-NG |
| AAA | NN-NI-NI | AAC | NG-NI-HD | ACA | NN-NN-HD | CAC | HD-NG-HD |
| AAA | NN-NI-NN | AAC | NG-NG-HD | ACA | NN-NN-NG | CAC | NN-NI-HD |
| AAA | NN-NI-NG | AAC | NN-NN-HD | ACA | NG-HD-HD | CAC | NN-NN-HD |
| AAA | NN-NN-HD | AAC | NN-NN-HD | ACA | NG-NN-NG | CAC | NG-NI-HD |
| AAA | NN-NN-NN | AAC | NI-HD-NN | ACA | NG-NG-NN | CAC | HD-NN-HD |
| AAA | NN-NG-NI | AAG | NI-NN-NN | ACA | NI-HD-HD | CAC | NG-NN-HD |
| AAA | NN-NG-NN | AAG | NI-NG-NN | ACA | HD-HD-NN | CAG | HD-HD-NN |
| AAA | NN-NG-NG | AAG | HD-NI-NN | ACA | HD-NN-NG | CAG | HD-NN-NN |
| AAA | NG-NI-NI | AAG | HD-HD-NN | ACA | HD-NG-NI | CAG | NG-HD-NN |
| AAA | NG-HD-NI | AAG | HD-NN-NI | ACA | NN-HD-HD | CAG | NG-NN-NN |
| AAA | NG-HD-NN | AAG | HD-NN-NN | ACA | NG-HD-NN | CAT | NI-NI-NG |
| AAA | NG-NN-NN | AAG | HD-NN-NG | ACA | NG-HD-NG | CAT | NI-HD-NI |
| AAA | NG-NG-NI | AAG | HD-NG-NN | ACA | NG-NG-NI | CAT | HD-NG-NG |
| AAA | NI-HD-NI | AAG | NN-NI-NN | ACA | NI-HD-NI | CAT | NG-HD-NG |
| AAA | NI-NN-NI | AAG | NN-HD-NI | ACA | NI-HD-NN | CAT | HD-NN-NG |
| AAA | NI-NN-NG | AAG | NN-HD-NG | ACA | NI-HD-NG | CAT | NN-NI-NG |
| AAA | HD-NG-NI | AAG | NN-NN-NI | ACA | NN-HD-NI | CAT | NG-NI-NG |
| AAA | HD-NG-HD | AAG | NN-NN-NN | ACA | NN-HD-NN | CAT | NG-NN-NG |
| AAA | NN-HD-NI | AAG | NN-NN-NG | ACA | NN-HD-NG | | |
| AAA | NN-HD-NN | AAG | NN-NG-NN | | | | |
| AAA | NN-HD-NG | AAG | NN-NG-NN | | | | |
| AAA | NN-NN-NI | AAG | NG-HD-NN | | | | |
| AAA | NN-NN-NG | AAG | NG-NN-NN | | | | |
| AAA | NG-NI-NN | AAG | NG-NN-NG | | | | |
| AAA | NG-NI-NG | AAG | NG-NG-NN | | | | |
| AAA | NG-HD-NG | AAG | NN-HD-NN | | | | |
| AAA | NG-NN-NI | AAG | NG-NI-NN | | | | |
| AAA | NG-NN-HD | | | | | | |
| AAA | NG-NN-NG | | | | | | |
| AAA | NG-NG-NG | | | | | | |

TABLE 6

Ranking of DNA target sequence off-site of example 3

| Target Name | Target Sequence | SEQ ID | Targeting specificity Score |
|---|---|---|---|
| S1 | TTGTCCCACAGATATC | SEQ ID NO. 86 | 0.256 |
| S2 | TTGTCCCACAGATATA | SEQ ID NO. 87 | 0.245 |
| S3 | TCGTCCCACAGATATC | SEQ ID NO. 88 | 0.221 |
| S4 | TAGTCCCACAGATATC | SEQ ID NO. 89 | 0.219 |
| S5 | TCGTCCCACAGATATA | SEQ ID NO. 90 | 0.212 |
| S6 | TTATCCCACAGATATC | SEQ ID NO. 91 | 0.211 |
| S7 | TAGTCCCACAGATATA | SEQ ID NO. 92 | 0.21 |
| S8 | TTATCCCACAGATATA | SEQ ID NO. 93 | 0.202 |
| S9 | TTGTACCACAGATATC | SEQ ID NO. 94 | 0.199 |

TABLE 7

Ranking of RVDs sequences according to their predicted targeting specificity

| Mutant Name | Mutant | Score |
|---|---|---|
| M1 | NG-NN-NG-HD-HD-HD-NN-HD-NI-NN-NN-NG-NI-NG-HD | 0.311 |
| M2 | NG-NN-NG-HD-HD-HD-NN-HD-NN-NN-NI-NG-HD-NG-HD | 0.298 |
| M3 | NG-NN-NG-HD-HD-HD-NI-HD-NI-NN-NN-NG-NI-NG-HD | 0.298 |
| M4 | NG-NN-NG-HD-HD-HD-NN-HD-NN-NN-NN-NG-NI-NG-HD | 0.296 |
| M5 | NG-NN-NG-HD-HD-HD-NI-HD-NN-NN-NI-NG-HD-NG-HD | 0.284 |
| M6 | NG-NN-NG-HD-HD-HD-NN-HD-NI-NN-NI-NG-HD-NG-HD | 0.283 |
| M7 | NG-NN-NG-HD-HD-HD-NI-HD-NN-NN-NN-NG-NI-NG-HD | 0.282 |
| M8 | NG-NN-NG-HD-HD-HD-NN-HD-NN-NN-NI-NG-NI-NG-HD | 0.282 |
| M9 | NG-NN-NG-HD-HD-HD-NN-HD-NN-NN-NI-NG-NN-NG-HD | 0.282 |
| M10 | NG-NN-NG-HD-HD-HD-NI-HD-NI-NN-NI-NG-HD-NG-HD | 0.271 |
| M11 | NG-NN-NG-HD-HD-HD-NI-HD-NN-NN-NI-NG-NI-NG-HD | 0.269 |
| M12 | NG-NN-NG-HD-HD-HD-NI-HD-NN-NN-NI-NG-NN-NG-HD | 0.268 |
| M13 | NG-NN-NG-HD-HD-HD-NN-HD-NI-NN-NI-NG-NI-NG-HD | 0.267 |
| M14 | NG-NN-NG-HD-HD-HD-NN-HD-NI-NN-NI-NG-NN-NG-HD | 0.267 |
| M15 | NG-NN-NG-HD-HD-HD-NI-HD-NI-NN-NI-NG-NI-NG-HD | 0.256 |
| M16 | NG-NN-NG-HD-HD-HD-NI-HD-NI-NN-NI-NG-NN-NG-HD | 0.256 |
| M17 | NG-NN-NG-HD-HD-HD-NN-HD-NN-NN-NI-NG-NG-NG-HD | 0.249 |
| M18 | NG-NI-NG-HD-HD-HD-NN-HD-NI-NN-NN-NG-NI-NG-HD | 0.246 |
| M19 | NG-NN-NG-HD-HD-HD-NN-HD-NI-NN-NN-NG-HD-NG-HD | 0.245 |
| M20 | NG-NN-NG-HD-HD-HD-NN-HD-NI-NN-NN-NG-NI-NG-NG | 0.243 |
| M21 | NG-NN-NG-HD-HD-HD-NI-HD-NN-NN-NI-NG-NG-NG-HD | 0.237 |
| M22 | NG-NN-NG-HD-HD-HD-NN-HD-NI-NN-NN-NG-NN-NG-HD | 0.237 |
| M23 | NG-NN-NG-HD-HD-HD-NN-HD-NI-NN-NI-NG-NG-NG-HD | 0.236 |
| M24 | NG-NI-NG-HD-HD-HD-NN-HD-NN-NN-NI-NG-HD-NG-HD | 0.236 |
| M25 | NG-NI-NG-HD-HD-HD-NI-HD-NI-NN-NN-NG-NI-NG-HD | 0.236 |
| M26 | NG-NN-NG-HD-HD-HD-NI-HD-NN-NN-NN-NG-HD-NG-HD | 0.235 |
| M27 | NG-NI-NG-HD-HD-HD-NN-HD-NN-NN-NN-NG-NI-NG-HD | 0.234 |
| M28 | NG-NN-NG-HD-HD-HD-NN-HD-NN-NN-NN-NG-HD-NG-HD | 0.233 |
| M29 | NG-NN-NG-HD-HD-HD-NI-HD-NI-NN-NN-NG-NI-NG-NG | 0.233 |
| M30 | NG-NN-NG-HD-HD-HD-NN-HD-NN-NN-NN-NG-NI-NG-NG | 0.232 |
| M31 | NG-NN-NG-HD-HD-HD-NI-HD-HD-NN-NN-NG-NI-NG-HD | 0.231 |
| M32 | NG-NN-NG-HD-HD-HD-NI-HD-NN-NN-NN-NG-NN-NG-HD | 0.227 |
| M33 | NG-NN-NG-HD-HD-HD-NI-HD-NI-NN-NI-NG-NG-NG-HD | 0.226 |
| M34 | NG-NN-NG-HD-HD-HD-NN-HD-NN-NN-NN-NG-NN-NG-HD | 0.226 |
| M35 | NG-NI-NG-HD-HD-HD-NI-HD-NN-NN-NI-NG-HD-NG-HD | 0.225 |
| M36 | NG-NN-NG-HD-HD-HD-NI-HD-HD-NN-NN-NI-HD-NG-HD | 0.224 |
| M37 | NG-NI-NG-HD-HD-HD-NN-HD-NI-NN-NI-NG-HD-NG-HD | 0.224 |
| M38 | NG-NI-NG-HD-HD-HD-NI-HD-NN-NN-NN-NG-NI-NG-HD | 0.223 |
| M39 | NG-NI-NG-HD-HD-HD-NN-HD-NN-NN-NI-NG-NI-NG-HD | 0.223 |
| M40 | NG-NI-NG-HD-HD-HD-NN-HD-NN-NN-NI-NG-NN-NG-HD | 0.223 |
| M41 | NG-NN-NG-HD-HD-HD-NI-HD-NN-NN-NN-NG-HD-NG-HD | 0.222 |
| M42 | NG-NN-NG-HD-HD-HD-NI-HD-NN-NN-NN-NG-NI-NG-NG | 0.221 |
| M43 | NG-NN-NG-HD-HD-HD-NN-HD-NN-NN-NI-NG-NI-NG-NG | 0.221 |
| M44 | NG-NN-NG-HD-HD-HD-NI-HD-NN-NN-NN-NG-NN-NG-HD | 0.215 |
| M45 | NG-NI-NG-HD-HD-HD-NI-HD-NI-NN-NI-NG-HD-NG-HD | 0.214 |

TABLE 7-continued

Ranking of RVDs sequences according to their predicted targeting specificity

| Mutant Name | Mutant | Score |
|---|---|---|
| M46 | NG-NN-NG-HD-HD-HD-NN-HD-NI-NN-NG-NG-NI-NG-HD | 0.213 |
| M47 | NG-NN-NG-HD-HD-HD-NG-HD-NI-NN-NN-NG-NI-NG-HD | 0.213 |
| M48 | NG-NI-NG-HD-HD-HD-NI-HD-NN-NN-NI-NG-NI-NG-HD | 0.213 |
| M49 | NG-NI-NG-HD-HD-HD-NI-HD-NN-NN-NI-NG-NN-NG-HD | 0.212 |
| M50 | NG-NN-NG-HD-HD-HD-NI-HD-HD-NN-NI-NG-NI-NG-HD | 0.212 |
| M51 | NG-NN-NG-HD-HD-HD-NI-HD-HD-NN-NI-NG-NN-NG-HD | 0.212 |
| M52 | NG-NI-NG-HD-HD-HD-NN-HD-NI-NN-NI-NG-NI-NG-HD | 0.212 |
| M53 | NG-NI-NG-HD-HD-HD-NN-HD-NI-NN-NI-NG-NN-NG-HD | 0.212 |
| M54 | NG-NN-NG-HD-HD-HD-NI-HD-NN-NN-NI-NG-NI-NG-NG | 0.21 |
| M55 | NG-NN-NG-HD-HD-HD-NN-HD-NI-NN-NI-NG-NI-NG-NG | 0.209 |
| M56 | NG-NN-NG-HD-HD-HD-NI-HD-NG-NN-NI-NG-HD-NG-HD | 0.209 |
| M57 | NG-NN-NG-HD-HD-HD-NN-HD-HD-NN-NN-NG-NI-NG-HD | 0.208 |
| M58 | NG-NN-NG-HD-HD-HD-NN-HD-NI-NN-NN-NG-NI-NG-NN | 0.208 |
| M59 | NG-NN-NG-HD-HD-HD-NN-HD-NI-NN-HD-NG-NI-NG-HD | 0.207 |
| M60 | NG-NN-NG-HD-HD-HD-HD-HD-NI-NN-NN-NG-NI-NG-HD | 0.206 |
| M61 | NG-NN-NG-HD-NG-HD-NI-HD-NI-NN-NN-NG-NI-NG-HD | 0.206 |
| M62 | NG-NN-NG-HD-HD-HD-NI-HD-NI-NN-NG-NG-NI-NG-HD | 0.204 |
| M63 | NG-NN-NG-HD-HD-HD-NN-HD-NG-NN-NI-NG-HD-NG-HD | 0.203 |
| M64 | NG-NI-NG-HD-HD-HD-NI-HD-NI-NN-NI-NG-NI-NG-HD | 0.203 |
| M65 | NG-NN-NG-HD-HD-HD-NN-HD-HD-NN-NI-NG-HD-NG-HD | 0.203 |
| M66 | NG-NI-NG-HD-HD-HD-NI-HD-NI-NN-NI-NG-NN-NG-HD | 0.203 |
| M67 | NG-NN-NG-HD-HD-HD-NI-HD-NG-NN-NN-NG-NI-NG-HD | 0.202 |
| M68 | NG-NN-NG-HD-HD-HD-NI-HD-NI-NN-NI-NG-NI-NG-NG | 0.2 |

TABLE 8

Endogenous (GFP) TALE-nuclease activity assay

| Tri-RVD $R_1R_2R_3$ | GFP neg. Cells [%] | RANK exp. | Predicted score | RANK pred. |
|---|---|---|---|---|
| NG-NN-HD | 28.8 | 1 | 28.84 | 1 |
| NG-NI-HD | 22.8 | 2 | 17.30 | 4 |
| NG-NN-NG | 22.2 | 3 | 21.05 | 2 |
| NG-NG-HD | 21 | 4 | 19.32 | 3 |
| NG-NN-NN | 19.8 | 5 | 14.71 | 5 |
| NG-NG-NG | 19.5 | 6 | 14.11 | 6 |
| NG-HD-HD | 18.9 | 7 | 9.23 | 10 |
| NG-NG-NN | 18.6 | 8 | 9.85 | 9 |
| NG-NI-NG | 18.3 | 9 | 12.63 | 7 |
| NG-NI-NN | 17.7 | 10 | 8.83 | 12 |
| NG-HD-NG | 14.7 | 11 | 6.74 | 14 |
| NG-NI-NI | 12.6 | 12 | 9.00 | 11 |
| NG-NG-NI | 9.4 | 13 | 10.05 | 8 |
| NN-NG-NI | 7.6 | 14 | 3.42 | 29 |
| NG-HD-NN | 6.5 | 15 | 4.71 | 22 |
| NI-NN-NN | 6.2 | 16 | 2.35 | 39 |
| NI-NN-NG | 5.9 | 17 | 3.37 | 30 |
| NN-NI-HD | 5.3 | 18 | 5.88 | 18 |
| NN-NI-NG | 5.1 | 19 | 4.29 | 23 |
| NG-HD-NI | 4.5 | 20 | 4.80 | 21 |
| HD-NN-NN | 4.4 | 21 | 5.88 | 17 |
| HD-NG-HD | 3.9 | 22 | 7.73 | 13 |
| NI-NG-HD | 3.6 | 23 | 3.09 | 33 |
| NN-NI-NN | 3.2 | 24 | 3.00 | 35 |
| HD-NN-NI | 2.8 | 25 | 6.00 | 16 |
| NN-HD-HD | 2.8 | 26 | 3.14 | 32 |
| HD-NG-NG | 2.7 | 27 | 5.64 | 19 |
| NN-NG-NN | 2.6 | 28 | 3.35 | 31 |
| HD-HD-HD | 2.5 | 29 | 3.69 | 26 |
| NN-NG-HD | 2.5 | 30 | 6.57 | 15 |
| NI-NI-HD | 2.5 | 31 | 2.77 | 36 |
| NI-NG-NG | 2.4 | 32 | 2.26 | 41 |
| HD-NI-NG | 2.4 | 33 | 5.05 | 20 |
| HD-NI-NN | 2.4 | 34 | 3.53 | 28 |
| HD-NG-NN | 2.3 | 35 | 3.94 | 25 |
| NI-HD-NG | 2.3 | 36 | 1.08 | 49 |
| NI-NN-NI | 2.3 | 37 | 2.40 | 38 |
| HD-NG-NI | 2.2 | 38 | 4.02 | 24 |
| NI-HD-HD | 2.2 | 39 | 1.48 | 46 |
| HD-NI-NI | 2.1 | 40 | 3.60 | 27 |
| NI-NI-NG | 2 | 41 | 2.02 | 42 |
| NI-NG-NN | 2 | 42 | 1.58 | 45 |
| NI-NG-NI | 2 | 43 | 1.61 | 44 |
| NI-HD-NN | 2 | 44 | 0.75 | 50 |
| NN-HD-NG | 1.9 | 45 | 2.29 | 40 |
| NI-NI-NN | 1.9 | 46 | 1.41 | 48 |
| HD-HD-NI | 1.9 | 47 | 1.92 | 43 |
| NI-NI-NI | 1.9 | 48 | 1.44 | 47 |
| HD-HD-NG | 1.8 | 49 | 2.69 | 37 |
| NN-NI-NI | 1.8 | 50 | 3.06 | 34 |

REFERENCES

Arnould, S., P. Chames, et al. (2006). "Engineering of large numbers of highly specific homing endonucleases that induce recombination on novel DNA targets." *J Mol Biol* 355(3): 443-58.

Boch, J., H. Scholze, et al. (2009). "Breaking the code of DNA binding specificity of TAL-type III effectors." *Science* 326(5959): 1509-12.

Chames, P., J. C. Epinat, et al. (2005). "In vivo selection of engineered homing endonucleases using double-strand break induced homologous recombination." *Nucleic Acids Res* 33(20): e178.

Epinat, J. C., S. Arnould, et al. (2003). "A novel engineered meganuclease induces homologous recombination in yeast and mammalian cells." *Nucleic Acids Res* 31(11): 2952-62.

Moscou, M. J. and A. J. Bogdanove (2009). "A simple cipher governs DNA recognition by TAL effectors." *Science* 326(5959): 1501.

Smith, J., S. Grizot, et al. (2006). "A combinatorial approach to create artificial homing endonucleases cleaving chosen sequences." *Nucleic Acids Res.*

SEQUENCE LISTING (204 sequences)

SEQ ID NO: 1 - protein, 1164 aa, Xanthomonas oryzae pv.
  TAL effector protein AvrBs3
MDPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPQQVVAIASNSGGKQALETVQRLLPVLCQAHGLTPEQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNSGGKQALETVQALLPVLCQAHGLTPEQVVAIASNSGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGRPALETVQRLLPVLCQAHGLTPEQVVAIASHDGGKQALETVQRLLPVLCQAHGLTPQQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGDQTRASSRKRSRSDRAVTGPSAQQSFEVRVPEQRDALHLPLSWRVKRPRTSIGGGLPDPGTPTAADLAASSTVMREQDEDPFAGAADDFPAFNEEELAWLMELLPQ

SEQ ID NO: 2 - protein, 34 aa, artificial sequence
  synthetic polypeptide: TALE repeat domain HD
LTPEQVVAIASHDGGKQALETVQRLLPVLCQAHG

SEQ ID NO: 3 - protein, 34 aa, artificial sequence
  synthetic polypeptide: TALE repeat domain NG
LTPQQVVAIASNGGGKQALETVQRLLPVLCQAHG

SEQ ID NO: 4 - protein, 34 aa, artificial sequence
  synthetic polypeptide: TALE repeat domain NI
LTPEQVVAIASNIGGKQALETVQALLPVLCQAHG

SEQ ID NO: 5 - protein, 34 aa, artificial sequence
  synthetic polypeptide: TALE repeat domain NN
LTPQQVVAIASNNGGKQALETVQRLLPVLCQAHG

SEQ ID NO: 6 - DNA, 306 bp, artificial sequence
  synthetic polypeptide: Tri repeat domain: NG-NG-NG
ttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggc

SEQ ID NO: 7 - DNA, 306 bp, artificial sequence
  synthetic polypeptide: Tri repeat domain: NG-NG-NI
ttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggc

SEQ ID NO: 8 - DNA, 306 bp, artificial sequence
  synthetic polypeptide: Tri repeat domain: NG-NG-NN
ttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggc

SEQ ID NO: 9 - DNA, 306 bp, artificial sequence
  synthetic polypeptide: Tri repeat domain: NG-NG-HD
ttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggc

SEQ ID NO: 10 - DNA, 306 bp, artificial sequence
  synthetic polypeptide: Tri repeat domain: NG-NI-NG
ttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggc

SEQ ID NO: 11 - DNA, 306 bp, artificial sequence
  synthetic polypeptide: Tri repeat domain: NG-NI-NI
ttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggc

SEQ ID NO: 12 - DNA, 306 bp, artificial sequence
  synthetic polypeptide: Tri repeat domain: NG-NI-NN
ttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggc

SEQ ID NO: 13 - DNA, 306 bp, artificial sequence
  synthetic polypeptide: Tri repeat domain: NG-NI-HD
ttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggc

SEQ ID NO: 14 - DNA, 306 bp, artificial sequence
  synthetic polypeptide: Tri repeat domain: NG-NN-NG
ttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggc

SEQ ID NO: 15 - DNA, 306 bp, artificial sequence
  synthetic polypeptide: Tri repeat domain: NG-NN-NI
ttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggc

SEQ ID NO: 16 - DNA, 306 bp, artificial sequence
  synthetic polypeptide: Tri repeat domain: NG-NN-NN
ttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggc

SEQ ID NO: 17 - DNA, 306 bp, artificial sequence
  synthetic polypeptide: Tri repeat domain: NG-NN-HD
ttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggc

SEQ ID NO: 18 - DNA, 306 bp, artificial sequence
  synthetic polypeptide: Tri repeat domain: NG-HD-NG
ttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggc

SEQ ID NO: 19 - DNA, 306 bp, artificial sequence
  synthetic polypeptide: Tri repeat domain: NG-HD-NI
ttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggc

SEQ ID NO: 20 - DNA, 306 bp, artificial sequence
  synthetic polypeptide: Tri repeat domain: NG-HD-NN
ttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggc

SEQ ID NO: 21 - DNA, 306 bp, artificial sequence
  synthetic polypeptide: Tri repeat domain: NG-HD-HD
ttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggc

SEQ ID NO: 22 - DNA, 306 bp, artificial sequence
  synthetic polypeptide: Tri repeat domain: NI-NG-NG
ttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggc

SEQ ID NO: 23 - DNA, 306 bp, artificial sequence
  synthetic polypeptide: Tri repeat domain: NI-NG-NI
ttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggc

SEQ ID NO: 24 - DNA, 306 bp, artificial sequence
  synthetic polypeptide: Tri repeat domain: NI-NG-NN
ttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggc

SEQ ID NO: 25 - DNA, 306 bp, artificial sequence
  synthetic polypeptide: Tri repeat domain: NI-NG-HD
ttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggc

SEQ ID NO: 26 - DNA, 306 bp, artificial sequence
  synthetic polypeptide: Tri repeat domain: NI-NI-NG
ttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggc

SEQ ID NO: 27 - DNA, 306 bp, artificial sequence
  synthetic polypeptide: Tri repeat domain: NI-NI-NI
ttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggc

SEQ ID NO: 28 - DNA, 306 bp, artificial sequence
  synthetic polypeptide: Tri repeat domain: NI-NI-NN
ttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggc

SEQ ID NO: 29 - DNA, 306 bp, artificial sequence
  synthetic polypeptide: Tri repeat domain: NI-NI-HD
ttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggc

SEQ ID NO: 30 - DNA, 306 bp, artificial sequence
  synthetic polypeptide: Tri repeat domain: NI-NN-NG
ttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggc

SEQ ID NO: 31 - DNA, 306 bp, artificial sequence
  synthetic polypeptide: Tri repeat domain: NI-NN-NI
ttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggc

SEQ ID NO: 32 - DNA, 306 bp, artificial sequence
  synthetic polypeptide: Tri repeat domain: NI-NN-NN
ttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggc

SEQ ID NO: 33 - DNA, 306 bp, artificial sequence
  synthetic polypeptide: Tri repeat domain: NI-NN-HD
ttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggc

SEQ ID NO: 34 - DNA, 306 bp, artificial sequence
  synthetic polypeptide: Tri repeat domain: NI-HD-NG
ttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggc

SEQ ID NO: 35 - DNA, 306 bp, artificial sequence
  synthetic polypeptide: Tri repeat domain: NI-HD-NI
ttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggc

SEQ ID NO: 36 - DNA, 306 bp, artificial sequence
  synthetic polypeptide: Tri repeat domain: NI-HD-NN
ttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggc

SEQ ID NO: 37 - DNA, 306 bp, artificial sequence
  synthetic polypeptide: Tri repeat domain: NI-HD-HD
ttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggc

SEQ ID NO: 38 - DNA, 306 bp, artificial sequence
  synthetic polypeptide: Tri repeat domain: NN-NG-NG
ttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggc

SEQ ID NO: 39 - DNA, 306 bp, artificial sequence
  synthetic polypeptide: Tri repeat domain: NN-NG-NI
ttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggc

SEQ ID NO: 40 - DNA, 306 bp, artificial sequence
  synthetic polypeptide: Tri repeat domain: NN-NG-NN
ttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggc

SEQ ID NO: 41 - DNA, 306 bp, artificial sequence
  synthetic polypeptide: Tri repeat domain: NN-NG-HD
ttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggc

SEQ ID NO: 42 - DNA, 306 bp, artificial sequence
  synthetic polypeptide: Tri repeat domain: NN-NI-NG
ttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggc

SEQ ID NO: 43 - DNA, 306 bp, artificial sequence
  synthetic polypeptide: Tri repeat domain: NN-NI-NI
ttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggc

SEQ ID NO: 44 - DNA, 306 bp, artificial sequence
  synthetic polypeptide: Tri repeat domain: NN-NI-NN
ttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggc

SEQ ID NO: 45 - DNA, 306 bp, artificial sequence
  synthetic polypeptide: Tri repeat domain: NN-NI-HD
ttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggc

SEQ ID NO: 46 - DNA, 306 bp, artificial sequence
  synthetic polypeptide: Tri repeat domain: NN-NN-NG
ttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggc

SEQ ID NO: 47 - DNA, 306 bp, artificial sequence
  synthetic polypeptide: Tri repeat domain: NN-NN-NI
ttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggc

SEQ ID NO: 48 - DNA, 306 bp, artificial sequence
  synthetic polypeptide: Tri repeat domain: NN-NN-NN
ttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggc

SEQ ID NO: 49 - DNA, 306 bp, artificial sequence
  synthetic polypeptide: Tri repeat domain: NN-NN-HD
ttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggc

SEQ ID NO: 50 - DNA, 306 bp, artificial sequence
  synthetic polypeptide: Tri repeat domain: NN-HD-NG
ttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggc

SEQ ID NO: 51 - DNA, 306 bp, artificial sequence
  synthetic polypeptide: Tri repeat domain: NN-HD-NI
ttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggc

SEQ ID NO: 52 - DNA, 306 bp, artificial sequence
  synthetic polypeptide: Tri repeat domain: NN-HD-NN
ttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggc

SEQ ID NO: 53 - DNA, 306 bp, artificial sequence
  synthetic polypeptide: Tri repeat domain: NN-HD-HD
ttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggc

SEQ ID NO: 54 - DNA, 306 bp, artificial sequence
  synthetic polypeptide: Tri repeat domain: HD-NG-NG
ttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggc

SEQ ID NO: 55 - DNA, 306 bp, artificial sequence
  synthetic polypeptide: Tri repeat domain: HD-NG-NI
ttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggc

SEQ ID NO: 56 - DNA, 306 bp, artificial sequence
  synthetic polypeptide: Tri repeat domain: HD-NG-NN
ttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggc

SEQ ID NO: 57 - DNA, 306 bp, artificial sequence
  synthetic polypeptide: Tri repeat domain: HD-NG-HD
ttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggc

SEQ ID NO: 58 - DNA, 306 bp, artificial sequence
  synthetic polypeptide: Tri repeat domain: HD-NI-NG
ttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggc

SEQ ID NO: 59 - DNA, 306 bp, artificial sequence
  synthetic polypeptide: Tri repeat domain: HD-NI-NI
ttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggc

SEQ ID NO: 60 - DNA, 306 bp, artificial sequence
  synthetic polypeptide: Tri repeat domain: HD-NI-NN
ttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggc

SEQ ID NO: 61 - DNA, 306 bp, artificial sequence
  synthetic polypeptide: Tri repeat domain: HD-NI-HD
ttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggc

SEQ ID NO: 62 - DNA, 306 bp, artificial sequence
  synthetic polypeptide: Tri repeat domain: HD-NN-NG
ttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggc

SEQ ID NO: 63 - DNA, 306 bp, artificial sequence
  synthetic polypeptide: Tri repeat domain: HD-NN-NI
ttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggc

SEQ ID NO: 64 - DNA, 306 bp, artificial sequence
  synthetic polypeptide: Tri repeat domain: HD-NN-NN
ttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggc

SEQ ID NO: 65 - DNA, 306 bp, artificial sequence
  synthetic polypeptide: Tri repeat domain: HD-NN-HD
ttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggc

SEQ ID NO: 66 - DNA, 306 bp, artificial sequence
  synthetic polypeptide: Tri repeat domain: HD-HD-NG
ttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggc

SEQ ID NO: 67 - DNA, 306 bp, artificial sequence
  synthetic polypeptide: Tri repeat domain: HD-HD-NI
ttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggc

SEQ ID NO: 68 - DNA, 306 bp, artificial sequence
  synthetic polypeptide: Tri repeat domain: HD-HD-NN
ttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggc

SEQ ID NO: 69 - DNA, 306 bp, artificial sequence
  synthetic polypeptide: Tri repeat domain: HD-HD-HD
ttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggc

SEQ ID NO: 70 - DNA, 672 bp, artificial sequence
  synthetic polypeptide: repeat array: Block 1 to 4
ttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggag

SEQ ID NO: 71 - DNA, 204 bp, artificial sequence
  synthetic polypeptide: repeat array: Block 1 to 2
ttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggc

SEQ ID NO: 72 - DNA, 468 bp, artificial sequence
  synthetic polypeptide: repeat array: block 6 to 10
ttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggag

SEQ ID NO: 73 - DNA, 408 bp, artificial sequence
  synthetic polypeptide: repeat array: Block 5 to 7
ttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggc

SEQ ID NO: 74 - DNA, 264 bp, artificial sequence
  synthetic polypeptide: repeat array: block 8 to 10
ttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggag

SEQ ID NO: 75 - DNA, 1590 bp, artificial sequence
  synthetic polypeptide: repeat array: block 4 to 19
ttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggag

SEQ ID NO: 76 - DNA, 1080 bp, artificial sequence
  synthetic polypeptide: repeat array: block 4 to 14
ttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggag

SEQ ID NO: 77 - DNA, 1722 bp, artificial sequence
  yeast expression plasmid: pCLS9944
atgggcgatcctaaaaagaaacgtaaggtcatcgattacccatacgatgttccagattacgctatcgatatcgccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccggagacgcccgggggatcaggtcacgtgcgtctcggagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 78 - protein, 530 aa, artificial sequence
  synthetic polypeptide: TALEN TRAC_T01-L1
LTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASHDGGKQALETVQRLLPVLCQAHGLTPQQVVAIASNGGGRPALE

SEQ ID NO: 79 - DNA, 17 bp, artificial sequence
  Target sequence: TRAC_T01-L1
ttgtcccacagatatct

SEQ ID NO: 80 - DNA, 1284 bp, artificial sequence
  synthetic polypeptide: repeat array: block 4 to 16
ttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggag

SEQ ID NO: 81 - DNA, 1668 bp, artificial sequence
  mammalian expression vector: pCLS8429
atgggcgatcctaaaaagaaacgtaaggtcatcgataaggagaccgccgctgccaagttcgagagacagcacatggacagcatcgatatcgccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccggagacgcccgggggatcaggtcacgtgcgtctcggagcattgttgcccagttatctcgccctgatccgagtggcagcggaagtggcggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgcttga

SEQ ID NO: 82 - protein, 530 aa, artificial sequence
  synthetic polypeptide: TALEN GFPT3.4
LTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALE

SEQ ID NO: 83 - DNA, 16 bp, artificial sequence
  Target sequence: GFPT3.4
tgccgtcctccttgaa

SEQ ID NO: 84 - DNA, 3126 bp, artificial sequence
  mammalian expression vector: pCLS9749
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgagtggcagcggaagtggcggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgac

SEQ ID NO: 85 - DNA, 46 bp, artificial sequence
  Target sequence: GFPT3.1
tgaaccgcatcgagctgaagggcatcgacttcaaggaggacggcaa

SEQ ID NO: 86 - DNA, 16 bp, artificial sequence
  target sequence: S1
ttgtcccacagatatc

SEQ ID NO: 87 - DNA, 16 bp, artificial sequence
  target sequence: S2
ttgtcccacagatata

SEQ ID NO: 88 - DNA, 16 bp, artificial sequence
  target sequence: S3
tcgtcccacagatatc

SEQ ID NO: 89 - DNA, 16 bp, artificial sequence
  target sequence: S4
tagtcccacagatatc

SEQ ID NO: 90 - DNA, 16 bp, artificial sequence
  target sequence: S5
tcgtcccacagatata

SEQ ID NO: 91 - DNA, 16 bp, artificial sequence
  target sequence: S6
ttatcccacagatatc

SEQ ID NO: 92 - DNA, 16 bp, artificial sequence
  target sequence: S7
tagtcccacagatata

SEQ ID NO: 93 - DNA, 16 bp, artificial sequence
  target sequence: S8
ttatcccacagatata

SEQ ID NO: 94 - DNA, 16 bp, artificial sequence
  target sequence: S9
ttgtaccacagatatc

SEQ ID NO: 95 - protein, 1071 aa, artificial sequence
  synthetic polypeptide: TALE repeat array: HD-HD-HD-HD-NN-NG-HD-HD-NG-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 96 - protein, 1071 aa, artificial sequence
  synthetic polypeptide: TALE repeat array: HD-HD-NG-HD-NN-NG-HD-HD-NG-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 97 - protein, 1071 aa, artificial sequence
  synthetic polypeptide: TALE repeat array: HD-HD-NI-HD-NN-NG-HD-HD-NG-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 98 - protein, 1071 aa, artificial sequence
  synthetic polypeptide: TALE repeat array: HD-NG-HD-HD-NN-NG-HD-HD-NG-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 99 - protein, 1071 aa, artificial sequence
  synthetic polypeptide: TALE repeat array: HD-NG-NG-HD-NN-NG-HD-HD-NG-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 100 - protein, 1071 aa, artificial sequence
  synthetic polypeptide: TALE repeat array: HD-NG-NI-HD-NN-NG-HD-HD-NG-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 101 - protein, 1071 aa, artificial sequence
  synthetic polypeptide: TALE repeat array: HD-NG-NN-HD-NN-NG-HD-HD-NG-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 102 - protein, 1071 aa, artificial sequence
  synthetic polypeptide: TALE repeat array: HD-NI-NG-HD-NN-NG-HD-HD-NG-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 103 - protein, 1071 aa, artificial sequence
  synthetic polypeptide: TALE repeat array: HD-NI-NI-HD-NN-NG-HD-HD-NG-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 104 - protein, 1071 aa, artificial sequence
  synthetic polypeptide: TALE repeat array: HD-NI-NN-HD-NN-NG-HD-HD-NG-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 105 - protein, 1071 aa, artificial sequence
  synthetic polypeptide: TALE repeat array: HD-NN-NI-HD-NN-NG-HD-HD-NG-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 106 - protein, 1071 aa, artificial sequence
  synthetic polypeptide: TALE repeat array: HD-NN-NN-HD-NN-NG-HD-HD-NG-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 107 - protein, 1071 aa, artificial sequence
  synthetic polypeptide: TALE repeat array: NG-HD-HD-HD-NN-NG-HD-HD-NG-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 108 - protein, 1071 aa, artificial sequence
  synthetic polypeptide: TALE repeat array: NG-HD-NG-HD-NN-NG-HD-HD-NG-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 109 - protein, 1071 aa, artificial sequence
  synthetic polypeptide: TALE repeat array: NG-HD-NI-HD-NN-NG-HD-HD-NG-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 110 - protein, 1071 aa, artificial sequence
  synthetic polypeptide: TALE repeat array: NG-HD-NN-HD-NN-NG-HD-HD-NG-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPEQVVAIASHDGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 111 - protein, 1071 aa, artificial sequence
  synthetic polypeptide: TALE repeat array: NG-NG-HD-HD-NN-NG-HD-HD-NG-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 112 - protein, 1071 aa, artificial sequence
  synthetic polypeptide: TALE repeat array: NG-NG-NG-HD-NN-NG-HD-HD-NG-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 113 - protein, 1071 aa, artificial sequence
  synthetic polypeptide: TALE repeat array: NG-NG-NI-HD-NN-NG-HD-HD-NG-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 114 - protein, 1071 aa, artificial sequence
  synthetic polypeptide: TALE repeat array: NG-NG-NN-HD-NN-NG-HD-HD-NG-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 115 - protein, 1071 aa, artificial sequence
  synthetic polypeptide: TALE repeat array: NG-NI-HD-HD-NN-NG-HD-HD-NG-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 116 - protein, 1071 aa, artificial sequence
  synthetic polypeptide: TALE repeat array: NG-NI-NG-HD-NN-NG-HD-HD-NG-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 117 - protein, 1071 aa, artificial sequence
  synthetic polypeptide: TALE repeat array: NG-NI-NI-HD-NN-NG-HD-HD-NG-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 118 - protein, 1071 aa, artificial sequence
  synthetic polypeptide: TALE repeat array: NG-NI-NN-HD-NN-NG-HD-HD-NG-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 119 - protein, 1071 aa, artificial sequence
  synthetic polypeptide: TALE repeat array: NG-NN-HD-HD-NN-NG-HD-HD-NG-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 120 - protein, 1071 aa, artificial sequence
  synthetic polypeptide: TALE repeat array: NG-NN-NG-HD-NN-NG-HD-HD-NG-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 121 - protein, 1071 aa, artificial sequence
  synthetic polypeptide: TALE repeat array: NG-NN-NN-HD-NN-NG-HD-HD-NG-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 122 - protein, 1071 aa, artificial sequence
  synthetic polypeptide: TALE repeat array: NI-HD-HD-HD-NN-NG-HD-HD-NG-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 123 - protein, 1071 aa, artificial sequence
  synthetic polypeptide: TALE repeat array: NI-HD-NG-HD-NN-NG-HD-HD-NG-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQALLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 124 - protein, 1071 aa, artificial sequence
  synthetic polypeptide: TALE repeat array: NI-HD-NN-HD-NN-NG-HD-HD-NG-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQALLPVLCQAHGLTPEQVVAIASHDGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 125 - protein, 1071 aa, artificial sequence
  synthetic polypeptide: TALE repeat array: NI-NG-HD-HD-NN-NG-HD-HD-NG-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQALLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 126 - protein, 1071 aa, artificial sequence
  synthetic polypeptide: TALE repeat array: NI-NG-NG-HD-NN-NG-HD-HD-NG-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 127 - protein, 1071 aa, artificial sequence
  synthetic polypeptide: TALE repeat array: NI-NG-NI-HD-NN-NG-HD-HD-NG-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 128 - protein, 1071 aa, artificial sequence
  synthetic polypeptide: TALE repeat array: NI-NG-NN-HD-NN-NG-HD-HD-NG-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQALLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 129 - protein, 1071 aa, artificial sequence
  synthetic polypeptide: TALE repeat array: NI-NI-HD-HD-NN-NG-HD-HD-NG-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 130 - protein, 1071 aa, artificial sequence
  synthetic polypeptide: TALE repeat array: NI-NI-NG-HD-NN-NG-HD-HD-NG-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQALLPVLCQAHGLTPEQVVAIASNIGGKQALETVQALLPVLCQAHGLTPQQVVAIASNGGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 131 - protein, 1071 aa, artificial sequence
  synthetic polypeptide: TALE repeat array: NI-NI-NI-HD-NN-NG-HD-HD-NG-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 132 - protein, 1071 aa, artificial sequence
  synthetic polypeptide: TALE repeat array: NI-NI-NN-HD-NN-NG-HD-HD-NG-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQALLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 133 - protein, 1071 aa, artificial sequence
  synthetic polypeptide: TALE repeat array: NI-NN-NG-HD-NN-NG-HD-HD-NG-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQALLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 134 - protein, 1071 aa, artificial sequence
  synthetic polypeptide: TALE repeat array: NI-NN-NI-HD-NN-NG-HD-HD-NG-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQALLPVLCQAHGLTPQQVVAIASNNGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 135 - protein, 1071 aa, artificial sequence
  synthetic polypeptide: TALE repeat array: NI-NN-NN-HD-NN-NG-HD-HD-NG-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQALLPVLCQAHGLTPQQVVAIASNNGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 136 - protein, 1071 aa, artificial sequence
  synthetic polypeptide: TALE repeat array: NN-NG-HD-HD-NN-NG-HD-HD-NG-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 137 - protein, 1071 aa, artificial sequence
  synthetic polypeptide: TALE repeat array: NN-NG-NI-HD-NN-NG-HD-HD-NG-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 138 - protein, 1071 aa, artificial sequence
  synthetic polypeptide: TALE repeat array: NN-NG-NN-HD-NN-NG-HD-HD-NG-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 139 - protein, 1071 aa, artificial sequence
  synthetic polypeptide: TALE repeat array: NN-NI-HD-HD-NN-NG-HD-HD-NG-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 140 - protein, 1071 aa, artificial sequence
  synthetic polypeptide: TALE repeat array: NN-NI-NG-HD-NN-NG-HD-HD-NG-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 141 - protein, 1071 aa, artificial sequence
  synthetic polypeptide: TALE repeat array: NN-NI-NI-HD-NN-NG-HD-HD-NG-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 142 - protein, 1071 aa, artificial sequence
  synthetic polypeptide: TALE repeat array: NN-NI-NN-HD-NN-NG-HD-HD-NG-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 143 - protein, 1071 aa, artificial sequence
  synthetic polypeptide: TALE repeat array: NG-NN-HD-HD-NN-NG-HD-HD-NG-HD-HD-NG-NG-HD-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 144 - protein, 1071 aa, artificial sequence
  synthetic polypeptide: TALE repeat array: NG-NN-HD-HD-NN-NG-HD-HD-NG-HD-HD-NG-NG-NG-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 145 - protein, 1071 aa, artificial sequence
  synthetic polypeptide: TALE repeat array: NG-NN-HD-HD-NN-NG-HD-HD-NG-HD-HD-NG-NN-NI-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 146 - protein, 1071 aa, artificial sequence
  synthetic polypeptide: TALE repeat array: NG-NN-HD-HD-NN-NG-HD-HD-NG-HD-HD-NG-NN-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 147 - protein, 1071 aa, artificial sequence
  synthetic polypeptide: TALE repeat array: NG-NN-HD-HD-NN-NG-HD-HD-NG-HD-HD-NI-HD-HD-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 148 - protein, 1071 aa, artificial sequence
  synthetic polypeptide: TALE repeat array: NG-NN-HD-HD-NN-NG-HD-HD-NG-HD-HD-NI-HD-NG-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 149 - protein, 1071 aa, artificial sequence
  synthetic polypeptide: TALE repeat array: NG-NN-HD-HD-NN-NG-HD-HD-NG-HD-HD-NI-HD-NI-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 150 - protein, 1071 aa, artificial sequence
  synthetic polypeptide: TALE repeat array: NG-NN-HD-HD-NN-NG-HD-HD-NG-HD-HD-NI-NG-HD-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 151 - protein, 1071 aa, artificial sequence
  synthetic polypeptide: TALE repeat array: NG-NN-HD-HD-NN-NG-HD-HD-NG-HD-HD-NI-NG-NG-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 152 - protein, 1071 aa, artificial sequence
  synthetic polypeptide: TALE repeat array: NG-NN-HD-HD-NN-NG-HD-HD-NG-HD-HD-NI-NG-NI-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 153 - protein, 1071 aa, artificial sequence
  synthetic polypeptide: TALE repeat array: NG-NN-HD-HD-NN-NG-HD-HD-NG-HD-HD-NI-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 154 - protein, 1071 aa, artificial sequence
  synthetic polypeptide: TALE repeat array: NG-NN-HD-HD-NN-NG-HD-HD-NG-HD-HD-NI-NI-HD-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 155 - protein, 1071 aa, artificial sequence
  synthetic polypeptide: TALE repeat array: NG-NN-HD-HD-NN-NG-HD-HD-NG-HD-HD-NI-NI-NG-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 156 - protein, 1071 aa, artificial sequence
  synthetic polypeptide: TALE repeat array: NG-NN-HD-HD-NN-NG-HD-HD-NG-HD-HD-NI-NI-NI-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 157 - protein, 1071 aa, artificial sequence
  synthetic polypeptide: TALE repeat array: NG-NN-HD-HD-NN-NG-HD-HD-NG-HD-HD-NI-NN-HD-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 158 - protein, 1071 aa, artificial sequence
  synthetic polypeptide: TALE repeat array: NG-NN-HD-HD-NN-NG-HD-HD-NG-HD-HD-NI-NN-NG-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 159 - protein, 1071 aa, artificial sequence
  synthetic polypeptide: TALE repeat array: NG-NN-HD-HD-NN-NG-HD-HD-NG-HD-HD-NI-NN-NI-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 160 - protein, 1071 aa, artificial sequence
  synthetic polypeptide: TALE repeat array: NG-NN-HD-HD-NN-NG-HD-HD-NG-HD-HD-NI-NN-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 161 - protein, 1071 aa, artificial sequence
  synthetic polypeptide: TALE repeat array: NG-NN-HD-HD-NN-NG-HD-HD-NG-HD-HD-NN-HD-HD-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 162 - protein, 1071 aa, artificial sequence
  synthetic polypeptide: TALE repeat array: NG-NN-HD-HD-NN-NG-HD-HD-NG-HD-HD-NN-HD-NG-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 163 - protein, 1071 aa, artificial sequence
  synthetic polypeptide: TALE repeat array: NG-NN-HD-HD-NN-NG-HD-HD-NG-HD-HD-NN-HD-NI-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 164 - protein, 1071 aa, artificial sequence
  synthetic polypeptide: TALE repeat array: NG-NN-HD-HD-NN-NG-HD-HD-NG-HD-HD-NN-HD-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 165 - protein, 1071 aa, artificial sequence
  synthetic polypeptide: TALE repeat array: NG-NN-HD-HD-NN-NG-HD-HD-NG-HD-HD-NN-NG-HD-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 166 - protein, 1071 aa, artificial sequence
  synthetic polypeptide: TALE repeat array: NG-NN-HD-HD-NN-NG-HD-HD-NG-HD-HD-NN-NG-NG-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 167 - protein, 1071 aa, artificial sequence
  synthetic polypeptide: TALE repeat array: NG-NN-HD-HD-NN-NG-HD-HD-NG-HD-HD-NN-NG-NI-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 168 - protein, 1071 aa, artificial sequence
  synthetic polypeptide: TALE repeat array: NG-NN-HD-HD-NN-NG-HD-HD-NG-HD-HD-NN-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 169 - protein, 1071 aa, artificial sequence
  synthetic polypeptide: TALE repeat array: NG-NN-HD-HD-NN-NG-HD-HD-NG-HD-HD-NN-NI-NI-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 170 - protein, 1071 aa, artificial sequence
  synthetic polypeptide: TALE repeat array: NG-NN-HD-HD-NN-NG-HD-HD-NG-HD-HD-NN-NI-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 171 - protein, 1071 aa, artificial sequence
  synthetic polypeptide: TALE repeat array: NG-NN-HD-HD-NN-NG-HD-HD-NG-HD-HD-NN-NN-HD-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 172 - protein, 1071 aa, artificial sequence
  synthetic polypeptide: TALE repeat array: NG-NN-HD-HD-NN-NG-HD-HD-NG-HD-HD-NN-NN-NG-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 173 - protein, 1071 aa, artificial sequence
  synthetic polypeptide: TALE repeat array: NG-NN-HD-HD-NN-NG-HD-HD-NG-HD-HD-NN-NN-NI-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 174 - protein, 1071 aa, artificial sequence
  synthetic polypeptide: TALE repeat array: NG-NN-HD-HD-NN-NG-HD-HD-NG-HD-HD-NN-NN-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 175 - protein, 1071 aa, artificial sequence
  synthetic polypeptide: TALE repeat array: NG-NN-HD-HD-NN-NG-HD-HD-NG-NN-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 176 - protein, 1071 aa, artificial sequence
  synthetic polypeptide: TALE repeat array: NG-NN-HD-HD-NN-NG-HD-HD-NG-NN-NN-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 177 - protein, 1071 aa, artificial sequence
  synthetic polypeptide: TALE repeat array: NG-NN-HD-HD-NN-NG-HD-HD-NG-NN-NG-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 178 - protein, 1071 aa, artificial sequence
  synthetic polypeptide: TALE repeat array: NG-NN-HD-HD-NN-NG-HD-HD-NG-NG-NI-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 179 - protein, 1071 aa, artificial sequence
  synthetic polypeptide: TALE repeat array: NG-NN-HD-HD-NN-NG-HD-HD-NG-NG-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 180 - protein, 1071 aa, artificial sequence
  synthetic polypeptide: TALE repeat array: NG-NN-HD-HD-NN-NG-HD-NI-NI-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 181 - protein, 1071 aa, artificial sequence
  synthetic polypeptide: TALE repeat array: NG-NN-HD-HD-NN-NG-HD-NI-HD-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 182 - protein, 1071 aa, artificial sequence
  synthetic polypeptide: TALE repeat array: NG-NN-HD-HD-NN-NG-HD-NI-NG-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 183 - protein, 1071 aa, artificial sequence
  synthetic polypeptide: TALE repeat array: NG-NN-HD-HD-NN-NG-HD-HD-NI-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 184 - protein, 1071 aa, artificial sequence
  synthetic polypeptide: TALE repeat array: NG-NN-HD-HD-NN-NG-HD-HD-HD-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 185 - protein, 1071 aa, artificial sequence
  synthetic polypeptide: TALE repeat array: NG-NN-HD-HD-NN-NG-HD-HD-NN-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 186 - protein, 1071 aa, artificial sequence
  synthetic polypeptide: TALE repeat array: NG-NN-HD-HD-NN-NG-HD-NN-NI-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 187 - protein, 1071 aa, artificial sequence
  synthetic polypeptide: TALE repeat array: NG-NN-HD-HD-NN-NG-HD-NN-HD-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 188 - protein, 1071 aa, artificial sequence
  synthetic polypeptide: TALE repeat array: NG-NN-HD-HD-NN-NG-HD-NN-NN-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 189 - protein, 1071 aa, artificial sequence
  synthetic polypeptide: TALE repeat array: NG-NN-HD-HD-NN-NG-HD-NN-NG-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 190 - protein, 1071 aa, artificial sequence
  synthetic polypeptide: TALE repeat array: NG-NN-HD-HD-NN-NG-HD-NG-HD-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 191 - protein, 1071 aa, artificial sequence
  synthetic polypeptide: TALE repeat array: NG-NN-HD-HD-NN-NG-HD-NG-NN-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 192 - protein, 1071 aa, artificial sequence
  synthetic polypeptide: TALE repeat array: NG-NN-HD-HD-NN-NG-HD-NG-NG-HD-HD-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 193 - protein, 1071 aa, artificial sequence
  synthetic polypeptide: TALE repeat array: NG-NN-HD-HD-NN-NG-HD-HD-NG-NI-NI-NG-NG-NN-NI
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 194 - protein, 1071 aa, artificial sequence
  synthetic polypeptide: TALE repeat array: NG-NN-HD-HD-NN-NG-HD-HD-NG-HD-HD-NG-NG-HD-HD
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 195 - protein, 1071 aa, artificial sequence
  synthetic polypeptide: TALE repeat array: NG-NN-HD-HD-NN-NG-HD-HD-NG-HD-HD-NG-NG-HD-NN
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 196 - protein, 1071 aa, artificial sequence
  synthetic polypeptide: TALE repeat array: NG-NN-HD-HD-NN-NG-HD-HD-NG-HD-HD-NG-NG-NG-HD
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 197 - protein, 1071 aa, artificial sequence
  synthetic polypeptide: TALE repeat array: NG-NN-HD-HD-NN-NG-HD-HD-NG-HD-HD-NG-NG-NG-NG
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 198 - protein, 1071 aa, artificial sequence
  synthetic polypeptide: TALE repeat array: NG-NN-HD-HD-NN-NG-HD-HD-NG-HD-HD-NG-NG-NG-NN
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 199 - protein, 1071 aa, artificial sequence
  synthetic polypeptide: TALE repeat array: NG-NN-HD-HD-NN-NG-HD-HD-NG-HD-HD-NG-NG-NI-HD
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 200 - protein, 1071 aa, artificial sequence
  synthetic polypeptide: TALE repeat array: NG-NN-HD-HD-NN-NG-HD-HD-NG-HD-HD-NG-NG-NI-NG
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 201 - protein, 1071 aa, artificial sequence
  synthetic polypeptide: TALE repeat array: NG-NN-HD-HD-NN-NG-HD-HD-NG-HD-HD-NG-NG-NI-NN
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 202 - protein, 1071 aa, artificial sequence
  synthetic polypeptide: TALE repeat array: NG-NN-HD-HD-NN-NG-HD-HD-NG-HD-HD-NG-NG-NN-HD
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 203 - protein, 1071 aa, artificial sequence
  synthetic polypeptide: TALE repeat array: NG-NN-HD-HD-NN-NG-HD-HD-NG-HD-HD-NG-NG-NN-NG
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 204 - protein, 1071 aa, artificial sequence
  synthetic polypeptide: TALE repeat array: NG-NN-HD-HD-NN-NG-HD-HD-NG-HD-HD-NG-NG-NN-NN
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

The invention claimed is:

1. A method for synthesizing a polynucleotide sequence encoding a transcription activator-like effector (TALE) protein, said protein having alternative targeting specificity towards a nucleic acid target sequence containing a nucleic acid base(s) G, wherein said method comprises assembling at least 9 polynucleotide sequences encoding RVDs (repeat variable disresidue), each RVD having specificity to a nucleic acid base in said nucleic acid target, and wherein at least one of said 9 RVDs are selected among the alternative RVD code:
NI or NG to target G, and
  wherein the RVD is within an RVD triplet selected from: NI-HD-NI for ATG; NI-HD-NI for GCA; NI-HD-NI for GTA; NI-HD-NN for GCG; NI-NN-NI for GAA; NI-NN-HD for GCC; NI-NN-NN for GAG; NI-NN-NN for GGG; NI-NN-NG for AGG; NI-NN-NG for GGT; NI-NG-NI for ATG; NI-NG-NI for GTA; NI-NG-HD for AGC; NI-NG-HD for GAC; NI-NG-HD for GTA; NI-NG-HD for GTC; NI-NG-NN for AGG; NI-NG-NN for GTA; NI-NG-NN for GTG; NI-NG-NG for GTT; HD-NN-NI for AAG; HD-NN-NI for AGG; HD-NN-NI for CGG; HD-NN-NG for AGG; HD-NN-NG for CGG; HD-NG-NI for ATG; HD-NG-NI for CGA; HD-NG-NI for CTG; HD-NG-HD for AGC; HD-NG-NN for AGG; HD-NG-NN for CGG; HD-NG-NG for AGT; HD-NG-NG for ATG; HD-NG-NG for CGT; HD-NG-NG for CTG; NN-NI-NI for AGA; NN-NI-NI for GGA; NN-NI-HD for AGC; NN-NI-HD for GGC; NN-NI-NN for GGA; NN-NI-NG for AGT; NN-NI-NG for GAG; NN-NI-NG for GGT; NN-HD-NI for AAG; NN-HD-NI for ACG; NN-HD-NI for GCG; NN-NN-NI for AAG; NN-NN-NI for AGG; NN-NN-NI for GAG; NN-NN-NI for GGG; NN-NN-NG for AGG; NN-NN-NG for GAG; NN-NN-NG for GGG; NN-NG-NI for AGA; NN-NG-NI for ATG; NN-NG-NI for GTG; NN-NG-HD for AGC; NN-NG-NN for AGG; NN-NG-NN for GGG; NN-NG-NG for ATG; NN-NG-NG for GGT; NN-NG-NG for GTG; NG-NI-NI for GAA; NG-NI-NI for TGA; NG-NI-HD for GAC; NG-NI-HD for TGC; NG-NI-NN for GAG; NG-NI-NN for TGA; NG-NI-NG for AGT; NG-NI-NG for GAT; NG-NI-NG for TAG; NG-NI-NG for TGT; NG-HD-NI for GCA; NG-HD-NI for TCG; NG-HD-HD for GCC; NG-HD-NN for GCA; NG-HD-NN for GCG; NG-NN-NI for GAA; NG-NN-NI for GGA; NG-NN-NI for TGG; NG-NN-HD for GAC; NG-NN-HD for GCC; NG-NN-HD for GGC; NG-NN-NN for GAG; NG-NN-NN for GGA; NG-NN-NN for GGG; NG-NN-NG for GGT; NG-NN-NG for TAG; NG-NN-NG for TGG; NG-NG-HD for GTC; NG-NG-HD for TGC; NG-NG-NN for GTA; NG-NG-NN for GTG; NG-NG-NN for TGG; NI-HD-NI for ATG; NI-HD-NI for GTA; NI-NG-HD for GAC; NG-NI-NG for AGT; and NG-NN-HD for GCC.

2. The method according to claim 1, wherein other RVDs in the TAL sequence follow the standard RVD code:
NI or NS to target A
NG, HG, or IG to target T
HD, HA, ND or HI to target C
NN, NK, HN or NA to target G.

3. A polynucleotide sequence encoding a transcription activator-like effector (TALE) protein obtainable by the method of claim 1.

4. A polypeptide encoded by the polynucleotide of claim 3.

5. A method for synthesizing a nucleic acid target sequence targetable by a transcription activator-like effector (TALE) protein having a RVD sequence containing at least NG or NI, wherein each base of said target sequence is respectively selected to target said RVDs of said transcription activator-like effector (TALE) protein, and wherein, at least one base in said target sequence is G in order to contact NI or NG, and
  wherein the RVD is within an RVD triplet selected from: NI-HD-NI for ATG; NI-HD-NI for GCA; NI-HD-NI for GTA; NI-HD-NN for GCG; NI-NN-NI for GAA; NI-NN-HD for GCC; NI-NN-NN for GAG; NI-NN-NN for GGG; NI-NN-NG for AGG; NI-NN-NG for GGT; NI-NG-NI for ATG; NI-NG-NI for GTA; NI-NG-HD for AGC; NI-NG-HD for GAC; NI-NG-HD for GTA; NI-NG-HD for GTC; NI-NG-NN for AGG; NI-NG-NN for GTA; NI-NG-NN for GTG; NI-NG-NG for GTT; HD-NN-NI for AAG; HD-NN-NI for AGG; HD-NN-NI for CGG; HD-NN-NG for AGG; HD-NN-NG for CGG; HD-NG-NI for ATG; HD-NG-NI for CGA; HD-NG-NI for CTG; HD-NG-HD for AGC; HD-NG-NN for AGG; HD-NG-NN for CGG; HD-NG-NG for AGT; HD-NG-NG for ATG; HD-NG-NG for CGT; HD-NG-NG for CTG; NN-NI-NI for AGA; NN-NI-NI for GGA; NN-NI-HD for AGC; NN-NI-HD for GGC; NN-NI-NN for GGA; NN-NI-NG for AGT; NN-NI-NG for GAG; NN-NI-NG for GGT; NN-HD-NI for AAG; NN-HD-NI for ACG; NN-HD-NI for GCG; NN-NN-NI for AAG; NN-NN-NI for AGG; NN-NN-NI for GAG; NN-NN-NI for GGG; NN-NN-NG for AGG; NN-NN-NG for GAG; NN-NN-NG for GGG; NN-NG-NI for AGA; NN-NG-NI for ATG; NN-NG-NI for GTG; NN-NG-HD for AGC; NN-NG-NN for AGG; NN-NG-NN for GGG; NN-NG-NG for ATG; NN-NG-NG for GGT; NN-NG-NG for GTG; NG-NI-NI for GAA; NG-NI-NI for TGA; NG-NI-HD for GAC; NG-NI-HD for TGC; NG-NI-NN for GAG; NG-NI-NN for TGA; NG-NI-NG for AGT; NG-NI-NG for GAT; NG-NI-NG for TAG; NG-NI-NG for TGT;

NG-HD-NI for GCA; NG-HD-NI for TCG; NG-HD-HD for GCC; NG-HD-NN for GCA; NG-HD-NN for GCG; NG-NN-NI for GAA; NG-NN-NI for GGA; NG-NN-NI for TGG; NG-NN-HD for GAC; NG-NN-HD for GCC; NG-NN-HD for GGC; NG-NN-NN for GAG; NG-NN-NN for GGA; NG-NN-NN for GGG; NG-NN-NG for GGT; NG-NN-NG for TAG; NG-NN-NG for TGG; NG-NG-HD for GTC; NG-NG-HD for TGC; NG-NG-NN for GTA; NG-NG-NN for GTG; NG-NG-NN for TGG; NI-HD-NI for ATG; NI-HD-NI for GTA; NI-NG-HD for GAC; NG-NI-NG for AGT; and NG-NN-HD for GCC.

6. The method according to claim 5, wherein the other nucleic acid bases are selected according to the standard RVD code:
A to target NI or NS
T to target NG, HG, or IG
C to target HD, HA, ND or HI, and
G to target NN, NK, HN or NA.

7. A method for modulating the specificity of a recombinant transcription activator-like effector (TALE) protein with respect to a nucleic acid target sequence that includes a nucleic acid base(s) G, wherein said method comprises introducing or replacing at least one RVD in the repeat domain of said TALE protein by NI or NG to target G, and wherein the RVD is within an RVD triplet selected from:
NI-HD-NI for ATG; NI-HD-NI for GCA; NI-HD-NI for GTA; NI-HD-NN for GCG; NI-NN-NI for GAA; NI-NN-HD for GGC; NI-NN-NN for GAG; NI-NN-NN for GGG; NI-NN-NG for AGG; NI-NN-NG for GGT; NI-NG-NI for ATG; NI-NG-NI for GTA; NI-NG-HD for AGC; NI-NG-HD for GAC; NI-NG-HD for GTA; NI-NG-HD for GTC; NI-NG-NN for AGG; NI-NG-NN for GTA; NI-NG-NN for GTG; NI-NG-NG for GTT; HD-NN-NI for AAG; HD-NN-NI for AGG; HD-NN-NI for CGG; HD-NN-NG for AGG; HD-NN-NG for CGG; HD-NG-NI for ATG; HD-NG-NI for CGA; HD-NG-NI for CTG; HD-NG-HD for AGC; HD-NG-NN for AGG; HD-NG-NN for CGG; HD-NG-NG for AGT; HD-NG-NG for ATG; HD-NG-NG for CGT; HD-NG-NG for CTG; NN-NI-NI for AGA; NN-NI-NI for GGA; NN-NI-HD for AGC; NN-NI-HD for GGC; NN-NI-NN for GGA; NN-NI-NG for AGT; NN-NI-NG for GAG; NN-NI-NG for GGT; NN-HD-NI for AAG; NN-HD-NI for ACG; NN-HD-NI for GCG; NN-NN-NI for AAG; NN-NN-NI for AGG; NN-NN-NI for GAG; NN-NN-NI for GGG; NN-NN-NG for AGG; NN-NN-NG for GAG; NN-NN-NG for GGG; NN-NG-NI for AGA; NN-NG-NI for ATG; NN-NG-NI for GTG; NN-NG-HD for AGC; NN-NG-NN for AGG; NN-NG-NN for GGG; NN-NG-NG for ATG; NN-NG-NG for GGT; NN-NG-NG for GTG; NG-NI-NI for GAA; NG-NI-NI for TGA; NG-NI-HD for GAC; NG-NI-HD for TGC; NG-NI-NN for GAG; NG-NI-NN for TGA; NG-NI-NG for AGT; NG-NI-NG for GAT; NG-NI-NG for TAG; NG-NI-NG for TGT; NG-HD-NI for GCA; NG-HD-NI for TCG; NG-HD-HD for GCC; NG-HD-NN for GCA; NG-HD-NN for GCG; NG-NN-NI for GAA; NG-NN-NI for GGA; NG-NN-NI for TGG; NG-NN-HD for GAC; NG-NN-HD for GCC; NG-NN-HD for GGC; NG-NN-NN for GAG; NG-NN-NN for GGA; NG-NN-NN for GGG; NG-NN-NG for GGT; NG-NN-NG for TAG; NG-NN-NG for TGG; NG-NG-HD for GTC; NG-NG-HD for TGC; NG-NG-NN for GTA; NG-NG-NN for GTG; NG-NG-NN for TGG; NI-HD-NI for ATG; NI-HD-NI for GTA; NI-NG-HD for GAC; NG-NI-NG for AGT; and NG-NN-HD for GCC.

8. A method for synthesizing a transcription activator-like effector (TALE) protein having an improved targeting specificity towards a target nucleic acid sequence, said method comprising introducing at least one RVD NI or NG to target G in position 1 or 2 of the nucleic acid target sequence, and wherein the RVD is within an RVD triplet selected from:
NI-HD-NI for GCA; NI-HD-NI for GTA; NI-HD-NN for GCG; NI-NN-NI for GAA; NI-NN-HD for GGC; NI-NN-NN for GAG; NI-NN-NN for GGG; NI-NN-NG for GGT; NI-NG-NI for GTA; NI-NG-HD for AGC; NI-NG-HD for GAC; NI-NG-HD for GTA; NI-NG-HD for GTC; NI-NG-NN for AGG; NI-NG-NN for GTA; NI-NG-NN for GTG; NI-NG-NG for GTT; HD-NG-NI for CGA; HD-NG-HD for AGC; HD-NG-NN for AGG; HD-NG-NN for CGG; HD-NG-NG for AGT; HD-NG-NG for CGT; NN-NI-NI for AGA; NN-NI-NI for GGA; NN-NI-HD for AGC; NN-NI-HD for GGC; NN-NI-NN for GGA; NN-NI-NG for AGT; NN-NI-NG for GGT; NN-NG-NI for AGA; NN-NG-HD for AGC; NN-NG-NN for AGG; NN-NG-NN for GGG; NN-NG-NG for GGT; NN-NG-NG for GTG; NG-NI-NI for GAA; NG-NI-NI for TGA; NG-NI-HD for GAC; NG-NI-HD for TGC; NG-NI-NN for GAG; NG-NI-NN for TGA; NG-NI-NG for AGT; NG-NI-NG for GAT; NG-NI-NG for TGT; NG-HD-NI for GCA; NG-HD-HD for GCC; NG-HD-NN for GCA; NG-HD-NN for GCG; NG-NN-NI for GAA; NG-NN-NI for GGA; NG-NN-HD for GAC; NG-NN-HD for GCC; NG-NN-HD for GGC; NG-NN-NN for GAG; NG-NN-NN for GGA; NG-NN-NN for GGG; NG-NN-NG for GGT; NG-NG-HD for GTC; NG-NG-HD for TGC; NG-NG-NN for GTA; NG-NG-NN for GTG; NG-NG-NN for TGG; NI-HD-NI for GTA; NI-NG-HD for GAC; NG-NI-NG for AGT; and NG-NN-HD for GCC.

* * * * *